United States Patent
van Deutekom et al.

(10) Patent No.: US 12,331,293 B2
(45) Date of Patent: Jun. 17, 2025

(54) BISPECIFIC ANTISENSE OLIGONUCLEOTIDES FOR DYSTROPHIN EXON SKIPPING

(71) Applicant: BioMarin Technologies B.V., Amsterdam (NL)

(72) Inventors: Judith Christina Theodora van Deutekom, Dordrecht (NL); Nicole Anne Datson, Oegstgeest (NL)

(73) Assignee: BIOMARIN TECHNOLOGIES B.V., Amsterdam (NL)

( * ) Notice: Subject to any disclaimer, the term of this patent is extended or adjusted under 35 U.S.C. 154(b) by 964 days.

(21) Appl. No.: 17/309,140

(22) PCT Filed: Oct. 30, 2019

(86) PCT No.: PCT/EP2019/079714
§ 371 (c)(1),
(2) Date: Apr. 29, 2021

(87) PCT Pub. No.: WO2020/089325
PCT Pub. Date: May 7, 2020

(65) Prior Publication Data
US 2022/0025368 A1 Jan. 27, 2022

(30) Foreign Application Priority Data
Nov. 2, 2018 (EP) .................................... 18204170

(51) Int. Cl.
*C12N 15/113* (2010.01)
*A61P 21/00* (2006.01)

(52) U.S. Cl.
CPC ............ *C12N 15/113* (2013.01); *A61P 21/00* (2018.01); *C12N 2310/11* (2013.01);
(Continued)

(58) Field of Classification Search
CPC .............. C12N 15/113; C12N 2310/11; C12N 2310/315; C12N 2310/321;
(Continued)

(56) References Cited

U.S. PATENT DOCUMENTS

| 7,534,879 B2 | 5/2009 | van Deutekom |
| 7,973,015 B2 | 7/2011 | van Ommen et al. |

(Continued)

FOREIGN PATENT DOCUMENTS

| EP | 3118311 A1 | 1/2017 |
| EP | 3159409 A1 | 4/2017 |

(Continued)

OTHER PUBLICATIONS

O'Dea T and McLaughlin LW, Curr Protoc Nucleic Acid Chem. May 2001; Chapter 5: Unit 5.3. (Year: 2001).*

(Continued)

*Primary Examiner* — Brian Whiteman
*Assistant Examiner* — Shabana S Meyering
(74) *Attorney, Agent, or Firm* — JONES DAY

(57) ABSTRACT

The current invention provides splice-switching compounds with improved characteristics that enhance clinical applicability preferably for treating, ameliorating, preventing, and/or delaying neuromuscular disorders, more specifically DMD.

15 Claims, 2 Drawing Sheets

Specification includes a Sequence Listing.

(52) U.S. Cl.
 CPC .. *C12N 2310/315* (2013.01); *C12N 2310/321* (2013.01); *C12N 2310/3231* (2013.01); *C12N 2310/51* (2013.01); *C12N 2320/33* (2013.01)

(58) Field of Classification Search
 CPC ........ C12N 2310/3231; C12N 2310/51; C12N 2320/33; C12N 2310/3341; C12N 2310/343; C12N 2310/3521; A61P 21/00; A61K 31/7125
 See application file for complete search history.

(56) References Cited

U.S. PATENT DOCUMENTS

| | | | |
|---|---|---|---|
| 8,263,760 | B2 | 9/2012 | de Kimpe et al. |
| 8,268,962 | B2 | 9/2012 | Heemskerk et al. |
| 8,304,398 | B2 | 11/2012 | 't Hoen et al. |
| 8,361,979 | B2 | 1/2013 | Aartsma-Rus et al. |
| 8,519,097 | B2 | 8/2013 | Heemskerk et al. |
| 8,609,065 | B2 | 12/2013 | Kuik-Romeijn et al. |
| 8,759,507 | B2 | 6/2014 | van Deutekom |
| 8,802,645 | B2 | 8/2014 | van Ommen et al. |
| 9,139,828 | B2 | 9/2015 | Platenburg et al. |
| 9,243,245 | B2 | 1/2016 | de Kimpe et al. |
| 9,499,818 | B2 | 11/2016 | van Deutekom |
| 9,528,109 | B2 | 12/2016 | de Kimpe et al. |
| 9,840,706 | B2 | 12/2017 | Watanabe et al. |
| 9,896,687 | B2 | 2/2018 | van Ommen et al. |
| 9,926,557 | B2 | 3/2018 | de Kimpe et al. |
| 10,100,304 | B2 | 10/2018 | van Deutekom |
| 10,113,165 | B2 | 10/2018 | Van Deutekom et al. |
| 10,179,912 | B2 | 1/2019 | de Visser et al. |
| 10,190,116 | B2 | 1/2019 | van Deutekom |
| 10,246,707 | B2 | 4/2019 | Platenburg et al. |
| 10,533,171 | B2 | 1/2020 | Van Deutekom et al. |
| 10,544,416 | B2 | 1/2020 | Van Deutekom |
| 10,876,114 | B2 | 12/2020 | Van Deutekom |
| 10,913,946 | B2 | 2/2021 | De Visser et al. |
| RE48,468 | E | 3/2021 | De Kimpe et al. |
| 11,034,956 | B2 | 6/2021 | Van Deutekom et al. |
| 11,053,497 | B2 | 7/2021 | Wakayama et al. |
| 2008/0200409 | A1 | 8/2008 | Wilson et al. |
| 2009/0269755 | A1 | 10/2009 | Aartsma-Rus et al. |
| 2011/0184050 | A1 | 7/2011 | De Kimpe et al. |
| 2013/0059902 | A1 | 3/2013 | Corey et al. |
| 2014/0045763 | A1 | 2/2014 | Aguilera Diez et al. |
| 2015/0191725 | A1 | 7/2015 | van Deutekom |
| 2015/0337002 | A1 | 11/2015 | Obika et al. |
| 2015/0368287 | A1 | 12/2015 | Mitsuoka et al. |
| 2016/0010090 | A1 | 1/2016 | Vagle |
| 2017/0067048 | A1* | 3/2017 | Wakayama ........... A61K 31/713 |
| 2017/0145409 | A1 | 5/2017 | Seth et al. |
| 2017/0204410 | A1* | 7/2017 | Watanabe ........... A61K 31/7125 |
| 2018/0028554 | A1 | 2/2018 | Van Deutekom et al. |
| 2019/0127733 | A1 | 5/2019 | Butler et al. |
| 2019/0177723 | A1 | 6/2019 | Dickson |
| 2020/0239886 | A1 | 7/2020 | De Kimpe et al. |
| 2020/0291399 | A1 | 9/2020 | Van Deutekom et al. |
| 2020/0385717 | A1 | 12/2020 | Van Deutekom |
| 2021/0108204 | A1 | 4/2021 | de Visser et al. |
| 2021/0139904 | A1 | 5/2021 | Van Deutekom |

FOREIGN PATENT DOCUMENTS

| | | | | |
|---|---|---|---|---|
| WO | WO-2004045543 | A2 * | 6/2004 | ........... A61K 31/713 |
| WO | 2010048586 | A1 | 4/2010 | |
| WO | 2016017422 | A1 | 2/2016 | |
| WO | 2018007475 | A1 | 1/2018 | |
| WO | WO-2018014042 | A1 * | 1/2018 | ........... A61K 9/0019 |

OTHER PUBLICATIONS

Gapmer Design [retrieved on Jun. 12, 2024], retrieved from the Internet: <URL: https://www.biosyn.com/tew/Gapmer-Design.aspx#!>) (Year: 2016).*
Wilton et al., Molecular Therapy 2007; 15:1288-1296.
Bestas et al., Nucleic Acid Ther. 2014; 24:13-24.
Aartsma-Rus et al., Hum. Mol. Gen. 2003; 12(8):907-14.
Arai et al., Bioorg. Med. Chem. 2011; 21:6285.
Beekman et al., PLoS One 2014; 9(9):e107494.
Beekman et al., PLoS One 2018; 13(4):e0195850.
Bolli et al., Chem Biol. 1996; 3(3):197-206.
Braida et al., Human Molecular Genetics 2010; 9:1399-1412.
Bruno, Advanced Drug Delivery Reviews 2011; 63:1210-1226.
Cao et al., Mol. Ther. Nucleic Acids 2016; 5(6):e329.
Cartegni et al., Nat. Rev. Genet. 2002; 3(4):285-98.
Cartegni et al., Nucleic Acids Res. 2003; 31(13):3568-71.
Cirak et al., Lancet 2011; 378:595-605.
Diebold et al., Eur. J. Immunol. 2006; 36(12):3256-67.
Disterer et al., Mol. Ther. 2013; 21(3):602-609.
Abdur Rahman et al., J. Am. Chem. Soc. 2008; 130(14):4886-4896.
Morita et al., Nucl. Acids Symp. Series 2001; 1(1):241-242.
Zhou et al., J. Org. Chem. 2010; 75(7):2341-2349.
Dugovic et al., J. Org. Chem. 2014; 79(3):1271-1279.
Medvecky et al., J. Org. Chem. 2015; 80(7):3556-3565.
Dominski and Kole, PNAS 1993; 90(18):8673-8677.
Dom and Kippenberger, Curr. Opin. Mol. Ther. 2008; 10(1):10-20.
Du et al., PNAS 2007; 104(14):6007-12.
Ehmsen J et al., J. Cell Sci. 2002; 115(Pt14):2801-2803.
Evers et al., PLoS One 2011; 6(9):e24308.
Evers et al., Nucleic Acid Ther. 2014; 24(1):4-12.
Fairbrother et al., Science 2002; 297(5583):1007-1013.
Fairbrother et al., Nucleic Acids 2004; 32:W187-190.
Friedman et al., J. Biol. Chem. 1999; 274(51):36193-36199.
Gao et al., Cell Transplant 2008; 17(7):723-34.
Gao et al., Mol. Ther. Nucleic Acids 2015; 4:e255.
Gedicke-Homung et al., EMBO Mol. Med. 2013; 5(7):1060-77.
Giles et al., Antisense Nucleic Acid Drug Dev. 1999; 9(2):213-20.
Goemans et al., N. Engl. J. Med. 2011; 364(16):1513-22.
Goto et al., J. Invest. Dermatol. 2006; 126(12):2614-20.
Goyenvalle et al., Nat. Med. 2015; 21(3):270-5.
Han et al., Nature Communications 2016; 7:10981.
Hanessian et al., J. Org. Chem. 2013; 78(18):9064-9075.
Heemskerk et al., Mol. Ther. 2010; 18(6):1210-7.
Hodgetts et al., Neuromuscular Disorders 2006; 16:591-602.
Hua et al., Am. J. Hum. Genet. 2008, 82(4): 834-48.
Hua et al., Nature 2011; 478(7367):123-6.
Karras et al., Biochemistry 2001; 40(26):7853-9.
Khoo et al., BMC Mol. Biol. 2007; 8:3.
Krieg et al., Nature 1995; 374:546-549.
Krieg, Curr. Opin. Immunol. 2000; 12: 35-43.
Kumar, Pharm. Technol. 2008; 3:128.
Lentz et al., Nat. Med. 2013; 19(3):345-350.
Mercatante et al., J. Biol. Chem. 2002; 277(51):49374-82.
Monaco et al., Genomics 1988; 2:90-95.
Murray et al., Nucl. Acids Res. 2012; 40(13):6135-6143.
Nishida et al., Chem. Commun. 2010; 46:5283.
Opalinska et al., Nucleic Acids Res. 2004; 32(19):5791-5795.
Osawa et al., J. Org. Chem. 2015; 80(21):10474-10481.
Osorio et al., Sci. Transl. Med. 2011; 3(106):106ra107.
Owen et al., PLOS One 2012; 7(3):e33576.
Peacey et al., NAR 2012; 40(19):9836-49.
Peacock et al., J. Am. Chem. Soc. 2011; 133:9200.
Popovic et al., J. of Immunol. 2006; 177:8701-8707.
Renshaw et al., Mol. Cancer Ther. 2004; 3(11):1467-84.
Rincon et al., Am. J. Hum. Genet. 2007; 81(6):1262-1270.
Seth et al., J. Org. Chem. 2010; 75:1569-1581.
Spitali et al., FASEB J. 2013; 27(12):4909-4916.
Taniguchi-Ikeda et al., Nature 2011; 478(7367):127-31.
Tyson-Capper et al., Mol. Pharmacol. 2006; 69(3):796-804.
Uchikawa et al., J. Hum. Genet. 2007; 52(11):891-897.
Uehara et al., FASEB J. 2013; 27(1):76-85.
Van Deutekom et al., N. Engl. J. Med. 2007; 357(26):2677-86.
Van Ommen et al., Curr. Opin. Mol. Ther. 2008; 10(2): 140-9.
Veltrop et al., PLoS One 2018; 13(2):e0193289.
Verheul et al., PLoS One 2016; 11(9):e0162467.
Vetrini et al., Hum. Mutat. 2006; 27(5):420-6.
Vickers et al., J. Immunol. 2006; 176(6):3652-61.

(56) References Cited

OTHER PUBLICATIONS

Voit et al., Lancet Neurol. 2014; 13(10):987-96.
Wagner, H., Adv. Immunol. 1999; 73:329-368.
Wein et al., Hum. Mut. 2010; 31(2):136-42.
Wheeler et al., J. Clin. Invest. 2007; 117(12):3952-7.
Williams et al., Oligonucleotides 2006; 16(2):186-95.
Yamamoto et al., Org. Biomol. Chem. 2015; 13:3757.
Yokota et al., Acta Myol. 2007; 26(3):179-84.
Straarup et al., Nucleic Acids Res. 2010; 38(20):7100-7111.
Zammarchi et al., PNAS 2011; 108(43):17779-84.
Zuker et al., Nucleic Acids Res. 2003; 31(13):3406-15.
Guterstam, et al., BioChem. J. 2008; 412:307-313.
Biscans, et al., Bioorg. & Med. Chem. 2015; 23:5360-5368.
Dohmen, et al., Mol. Ther. Nucl. Acids 2012; 1:e7.
Gao, et al., Mol. Therapy 2014; 22(7):1333-1341.
Jirka, et al., Nucl. Acid Ther. 2014; 24(1):25-36.
Echigoya, et al., "Quantitative antisense screening and optimization for exon 51 skipping in Duchenne muscular dystrophy" Mol. Therapy, 2017, 25(11), 2561-2572.

\* cited by examiner

BISPECIFIC ANTISENSE OLIGONUCLEOTIDES FOR DYSTROPHIN EXON SKIPPING

RELATED APPLICATIONS

This application is a 371 of International PCT Application No. PCT/EP2019/079714, filed Oct. 30, 2019, which claims priority to EP 18204170.7, filed Nov. 2, 2018, the disclosures of which are incorporated by reference herein in their entireties.

SEQUENCE LISTING

This application is being filed with a Sequence Listing in Computer Readable Format (CRF) entitled "0105_25_US_SL2.txt" having 8,078,347 bytes, created on Sep. 28, 2021, which is incorporated by reference in its entirety.

FIELD

The invention relates to the field of antisense oligonucleotides, more specifically splice-switching oligonucleotides preferably for the treatment of genetic disorders, more specifically neuromuscular disorders. The invention in particular relates to the use of oligonucleotide-based compounds with improved characteristics enhancing clinical applicability as further defined herein.

BACKGROUND OF THE INVENTION

Antisense oligonucleotides (AONs) are in (pre)clinical development for many diseases and conditions, including cancer, inflammatory conditions, cardiovascular disease and neurodegenerative and neuromuscular disorders. Their mechanism of action is aimed at various targets, such as RNaseH-mediated degradation of target RNA in the nucleus or cytoplasm, at splice-modulation (exon inclusion or skipping) in the nucleus, or at translation inhibition by steric hindrance of ribosomal subunit binding in the cytoplasm. Splice-modulating or splice-switching oligonucleotides (SSOs) were first described for correction of aberrant splicing in human β-globin pre-mRNAs (Dominski and Kole, 1993), and are currently being studied for a variety of genetic disorders including, but not limited to, cystic fibrosis (CFTR gene, Friedman et al., 1999), breast cancer (BRCA1 gene, Uchikawa et al., 2007), prostate cancer (FOLH1 gene, Williams et al., 2006), inflammatory diseases (IL-5Ralpha and MyD88 genes, Karras et al., 2001, Vickers et al., 2006), ocular albinism type 1 (OA1 gene, Vetrini et al., 2006), ataxia telangiectasia (ATM gene, Du et al., 2007), nevoid basal cell carcinoma syndrome (PTCH1 gene, Uchikawa et al., 2007), methylmalonic acidemia (MUT gene, Rincon et al., 2007), preterm labor (COX-2 gene, Tyson-Capper et al., 2006), artherosclerosis (APOB gene, Khoo et al., 2007), propionic acidemia (PCCA, PCCB genes, Rincon et al., 2007), leukemia (c-myc and WT1 genes, Renshaw et al., 2004, Giles et al., 1999), dystrophic epidermolysis bullosa (COL7A1 gene, Goto et al., 2006), familial hypercholesterolemia (APOB gene, Disterer et al., 2013), laser-induced choroidal neovascularization and corneal graft rejection (KDR gene, Uehara et al., 2013), hypertrophic cardiomyopathy (MYBPC3 gene, Gedicke-Hornung et al., 2013), Usher syndrome (USH1C gene, Lentz et al., 2013), fukuyama congenital muscular dystrophy (FKTN gene, Taniguchi-Ikeda et al., 2011), laser-induced choroidal neovascularization (FLT1 gene, Owen et al., 2012), cancer (STAT3 and bcl-X genes, Zammarchi et al., 2011, Mercatante et al., 2002), and Hutchinson-Gilford progeria (LMNA gene, Osorio et al., 2011), Miyoshi myopathy (DYSF gene, Wein et al., 2010), spinocerebellar ataxia type 1 (ATXN1 gene, Gao et al., 2008), Alzheimer's disease/FTDP-17 taupathies (MAPT gene, Peacey et al., 2012), myotonic dystrophy (CLC1 gene, Wheeler et al., 2007), and Huntington's disease (Evers et al., 2014). However, splice-switching AONs have progressed furthest in the treatment of the neuromuscular disorders Duchenne muscular dystrophy (DMD).

Duchenne muscular dystrophy (DMD) and Becker muscular dystrophy (BMD) are the most common childhood forms of muscular dystrophy. DMD is a severe, lethal neuromuscular disorder resulting in a dependency on wheelchair support before the age of 12 and patients often die before the age of thirty due to respiratory- or heart failure. It is caused by reading frame-shifting deletions (~67%) or duplications (~7%) of one or more exons, or by point mutations (~25%) in the 2.24 Mb DMD gene, resulting in the absence of functional dystrophin. BMD is also caused by mutations in the DMD gene, but these maintain the open reading frame, yield semi-functional dystrophin proteins, and result in a typically much milder phenotype and longer lifespan. During the last decade, specific modification of splicing in order to restore the disrupted reading frame of the transcript has emerged as a promising therapy for DMD (van Ommen et al., 2008; Yokota et al., 2007; van Deutekom et al., 2007; Goemans et al., 2011; Voit et al., 2014; Cirak et al., 2011). Using highly sequence-specific splice-switching antisense oligonucleotides (AONs) which bind to the exon flanking or containing the mutation and which interfere with its splicing signals, the skipping of that exon can be induced during the processing of the DMD pre-mRNA. Despite the resulting truncated transcript, the open reading frame is restored and a protein is produced which is similar to those found in BMD patients. AON-induced exon skipping provides a mutation-specific, and thus personalized, therapeutic approach for DMD patients. As the majority of the mutations cluster around exons 45 to 55, the skipping of one specific exon may be therapeutic for many patients with different mutations. The skipping of exon 51 applies to the largest subset of patients (~13%), including those with deletions of exons 45 to 50, 48 to 50, 50, or 52. The AONs applied can be chemically modified to resist endonucleases, exonucleases, and RNaseH, and to promote RNA binding and duplex stability. Different AON chemistries are currently being explored for inducing corrective exon skipping for DMD, including 2'-O-methyl phosphorothioate RNA (2OMePS; Voit et al., 2014), phosphorodiamidate morpholino (PMO; Cirak et al., 2011), tricyclo DNA (tcDNA; Goyenvalle et al, 2015), and peptide nucleic acid (PNA; Gao et al., 2015). Although AONs are typically not well taken up by healthy muscle fibers, the dystrophin deficiency in DMD and the resulting pathology, characterized by activated satellite cells and damaged and thus more permeable fiber membranes, actually facilitates a better uptake. In studies in the dystrophin-deficient mdx mouse model, 2'-O-methyl phosphorothioate RNA oligonucleotides have indeed demonstrated an up to 10 times higher uptake in different muscle groups when compared to that in wild type mice (Heemskerk et al., 2010). Clinical study results with both 2'-O-methyl phosphorothioate RNA and phosphorodiamidate morpholino AONs in DMD patients confirm presence of the AONs in muscle biopsies, but the levels of novel dystrophin after treatment were still limited, which challenges the field to develop oligonucleotides with improved characteristics enhancing therapeutic index and clinical applicability.

Clinical efficacy of systemically administered AONs, such as splice-switching AONs, depends on multiple factors such as administration route, biostability, biodistribution, intra-tissue distribution, uptake by target cells, and routing to the desired intracellular location (nucleus). Part of the invention shows that linking two AONs of the invention can lead to compounds that show improved characteristics for possible treatment of genetic disorders such as DMD.

DESCRIPTION OF THE INVENTION

Compound

Figure 1:
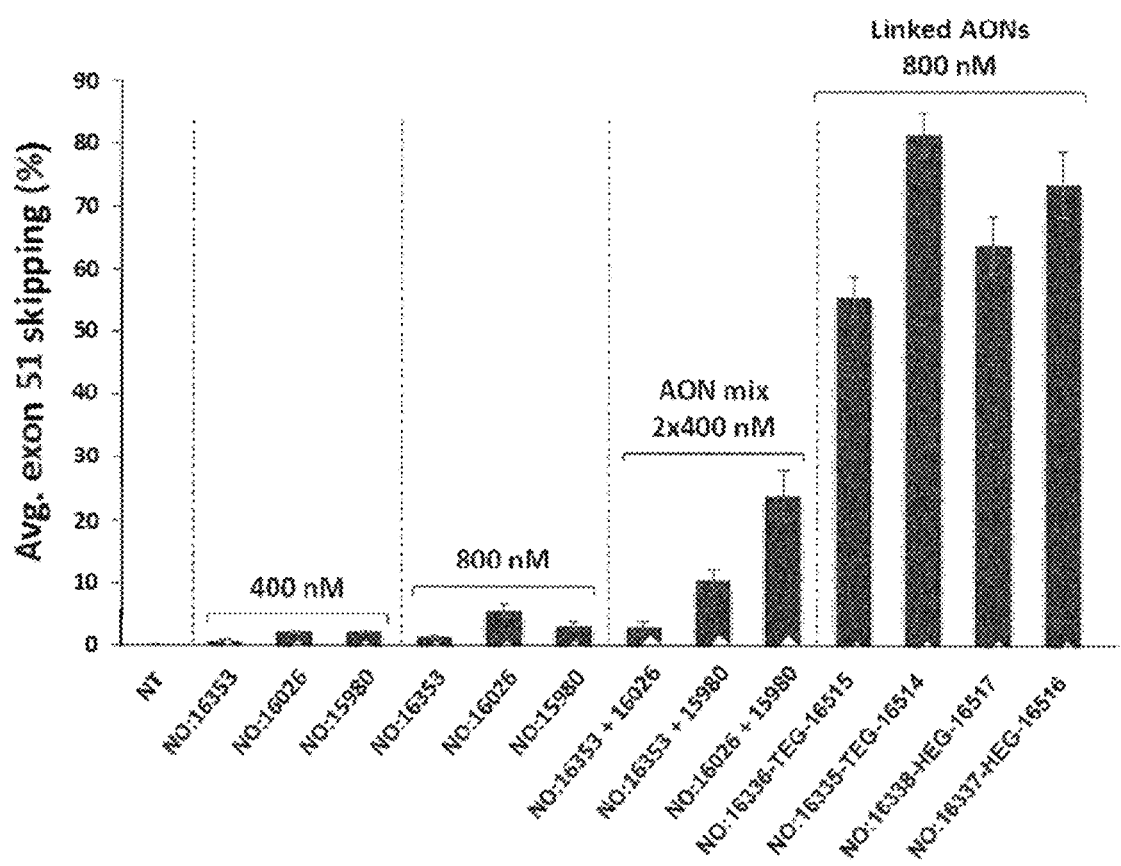
FIG. 1 is an RT-ddPCR analysis showing the synergistic effect of combining AONs, targeting distinct sequence stretches, on exon 51 skipping efficiencies in muscle cells from a DMD patient with a deletion of exons 48 to 50, especially by linking them by TEG=tri-ethylene glycol or HEG=hexa-ethylene glycol linkers. Individual AONs were tested at either 400 or 800 nM; the mixtures of AONs consisted of 400 nM of each individual AON; and the linked AONs were tested at 800 nM. Average exon 51 skipping percentages were determined based on RNA samples from 6 plate wells, error bars indicate standard deviation. NT=non-treated cells.

In a first aspect, the invention provides a compound comprising or consisting of a first and a second antisense oligonucleotide linked to each other by a linking moiety, wherein said first antisense oligonucleotide (AON) is complementary to or binds to or targets or hybridizes to or overlaps with at least a part of SEQ ID NO: 3, and wherein said second antisense oligonucleotide (AON) is complementary to or binds to or targets or hybridizes to or overlaps with at least a part of SEQ ID NO: 4, wherein SEQ ID NO: 3 and 4 are located within exon 51 of dystrophin pre-mRNA, preferably for use as a medicament, more preferably for treating, preventing and/or delaying Duchenne Muscular Dystrophy (DMD), even more preferably for inducing skipping of exon 51 of the dystrophin pre-mRNA as explained later herein. Preferably said first and second antisense oligonucleotides of the compound of the invention are distinct, more preferably the nucleotide sequence of said first and second antisense oligonucleotide are represented by a distinct SEQ ID NO. Preferably, said exon 51 of dystrophin pre-mRNA is from a human and is represented by a nucleotide sequence with SEQ ID NO: 2.

In the context of the invention, said SEQ ID NO: 3 represents a first ESE and/or ERS sequence, and said SEQ ID NO: 4 represents a second ESE and/or ERS sequence within exon 51 of the dystrophin pre-mRNA. Throughout the application, unless explicitly specified otherwise, said first ESE and/or ERS and said second ESE and/or ERS are distinct, preferably said first ESE and/or ERS and said second ESE and/or ERS are represented by a distinct SEQ ID NO.

In the context of the invention, "distinct" ESE and/or ERS sequences are located in different regions within exon 51 of the dystrophin pre-mRNA, i.e. said ESE and/or ERS sequences are only partly overlapping with each other within said exon, are adjacent to each other (no nucleotides separating both ESE and/or ERS sequences) or at least 1 nucleotide, preferably 5 nucleotides, separate both ESE and/or ERS sequences within said exon. The term "partly overlapping" is defined herein as to comprise an overlap of a single nucleotide or multiple nucleotides, preferably said overlap does not comprise more than 10, 9, 8, 7, 6, 5, 4, 3, 2 or 1 nucleotides, more preferably does not comprise more than 5 nucleotides. As such, the term "partly overlapping" can also be defined herein as to comprise an overlap of 5%, 10%, 15%, 20%, 25%, 30%, 35%, 40%, 45%, 50%, 55%, 60%, 65%, 70%, 75%, 80%, 85%, 90%, 95%, 96%, 97%, 98% or 99%, preferably said overlap is no more than 50%, 45%, 40%, 35%, 30%, 25%, 20%, 15%, 10%, 5% or 1%, more preferably no more than 20%, even more preferably no more than 10%, of the length of the shortest sequence of said first and second ESE and/or ERS. Alternatively, "distinct" ESE and/or ERS sequences are represented by a nucleotide sequence which are not 100% identical. Preferably, a first ESE and/or ERS and a second ESE and/or ERS are distinct when their nucleotide sequences do not completely overlap. More preferably, a first ESE and/or ERS and a second ESE and/or ERS are distinct when their corresponding nucleotide sequences either do not overlap or only partly overlap. The term "partly overlap" is defined herein as to comprise an overlap of a single nucleotide or multiple nucleotides, preferably said overlap does not comprise more than 10, 9, 8, 7, 6, 5, 4, 3, 2 or 1 nucleotides, more preferably does not comprise more than 5 nucleotides. As such, the term "partly overlaps" can also be defined herein as to comprise an overlap of 5%, 10%, 15%, 20%, 25%, 30%, 35%, 40%, 45%, 50%, 55%, 60%, 65%, 70%, 75%, 80%, 85%, 90%, 95%, 96%, 97%, 98% or 99%, preferably said overlap is no more than 50%, 45%, 40%, 35%, 30%, 25%, 20%, 15%, 10%, 5% or 1%, more preferably no more than 20%, even more preferably no more than 10%, of the length of the shortest sequence of said first and second ESE and/or ERS.

In the context of the invention, in a preferred embodiment, the oligonucleotides present in the compound of the invention are "distinct" (antisense) oligonucleotides and are represented by nucleotide sequences that preferably overlap with no more than 14, 13, 12, 11, 10, 9, 8, 7, 6, 5, 4, 3, 2, 1 or 0 nucleotides. Preferably, the nucleotide sequences of the first and second antisense oligonucleotide of the compound of the invention are represented by a distinct SEQ ID NO. Alternatively, the length of the sequence that overlaps between said "distinct" (antisense) oligonucleotides is preferably no more than 60%, 50%, 40%, 30%, 20%, 10%, 5% or 0% of the length of the shortest (antisense) oligonucleotide. In this context, said "distinct" (antisense) oligonucleotides are preferably represented by nucleotide sequences that do not overlap.

Preferably, "distinct" (antisense) oligonucleotides are oligonucleotides that bind to, target, hybridize to or are complementary to or overlap with non-overlapping sequences. More preferably, "distinct" (antisense) oligonucleotides are oligonucleotides that bind to, target, hybridize to or are complementary to or overlap with a distinct ESE and/or ERS within the same exon of said dystrophin pre-mRNA. ESE and ERS sequences are identified to regulate specific and efficient splicing of constitutive and alternative exons and are hence splicing elements/motifs.

Throughout this application, when the word "oligonucleotide" is used it may be replaced by "antisense oligonucleotide" and vice versa as defined herein unless otherwise indicated. Further, the words "oligonucleotide" or "antisense oligonucleotide" may be replaced by "first and/or second oligonucleotide" or "first and/or second antisense oligonucleotide" throughout the application unless otherwise indicated.

When such an oligonucleotide is complementary, it is understood that it can also be reverse complementary. In this application, the term "complementary" encompasses both forward complementary and reverse complementary sequences, as will be apparent to a skilled person from the context. As such, when "an oligonucleotide is complementary to" a target sequence is used, then it means that said oligonucleotide is reverse complementary to said target sequence as the sequence of the oligonucleotide is the reverse complement of the target sequence, unless otherwise stated. When "an antisense oligonucleotide is complementary to" a target sequence is used, then it means that said antisense oligonucleotide is complementary to said target sequence as the sequence of the antisense oligonucleotide is the reverse of the target sequence, unless otherwise stated.

In the context of the invention, said first and second antisense oligonucleotides are "linked to each other by a linking moiety" means that said antisense oligonucleotides are joined together through a linking moiety (as described in the section entitled "Linking moiety") and hence form a conjugate (or compound) comprising said first and second antisense oligonucleotides and linking moiety. In the context of the invention, "compound" may be interchanged throughout the document with "conjugate" as they have an identical meaning in this context. A compound according to the present invention is hence preferably different from a mixture or set of said first and second antisense oligonucleotide, where both antisense oligonucleotides are present as separate molecules, i.e. not linked to each other by a linking moiety.

In an embodiment, the invention as such provides a conjugate or compound comprising or consisting of a first and a second antisense oligonucleotide linked to each other by a linking moiety, wherein said first antisense oligonucleotide (AON) is complementary to or binds to or targets or hybridizes to or overlaps with at least a part of SEQ ID NO: 3, and wherein said second antisense oligonucleotide (AON) is complementary to or binds to or targets or hybridizes to or overlaps with at least a part of SEQ ID NO: 4, wherein SEQ ID NO: 3 and 4 are located within exon 51 of dystrophin pre-mRNA, preferably for use as a medicament, more preferably for treating, preventing and/or delaying Duchenne Muscular Dystrophy (DMD). Preferably said first and second antisense oligonucleotides are distinct as defined earlier herein.

In the context of the present invention, said first antisense oligonucleotide (AON) of the compound is complementary to or binds to or targets or hybridizes to or overlaps with at least a part of at least SEQ ID NO: 3, i.e. said first antisense oligonucleotide could additionally be complementary to or bind to or target or hybridize to or overlap with at least a part of one ore more additional ESE and/or ERS sequence(s) that are distinct from the first ESE and/or ERS corresponding with SEQ ID NO: 3 and that are located within exon 51 of dystrophin pre-mRNA, preferably for use as a medicament, more preferably for treating, preventing and/or delaying Duchenne Muscular Dystrophy (DMD).

In the context of the present invention, said second antisense oligonucleotide (AON) of the compound is complementary to or binds to or targets or hybridizes to or overlaps with at least a part of at least SEQ ID NO: 4, i.e. said second antisense oligonucleotide could additionally be complementary to or bind to or target or hybridize to or overlap with at least a part of one ore more additional ESE and/or ERS sequence(s) that are distinct from the second ESE and/or corresponding with SEQ ID NO: 4 and that are located within exon 51 of dystrophin pre-mRNA, preferably for use as a medicament, more preferably for treating, preventing and/or delaying Duchenne Muscular Dystrophy (DMD).

Dystrophin Exon

Throughout the application, unless explicitly specified otherwise, said first ESE and/or ERS and said second ESE and/or ERS are located within exon 51 of dystrophin pre-mRNA, wherein said first ESE and/or ERS is represented by SEQ ID NO: 3, and wherein said second ESE and/or ERS is represented by SEQ ID NO: 4. Accordingly, a compound of the invention is preferably for skipping exon 51 of dystrophin pre-mRNA.

Preferably, said exon 51 of dystrophin pre-mRNA is from a human and is represented by the following nucleotide sequence:

```
                                            (SEQ ID NO: 2)
5'-CUCCUACUCAGACUGUUACUCUGGGUGACACAACCUGUGGUUACUAA

GGAAACUGCCAUCUCCAAACUAGAAAUGCCAUCUUCCUUGAUGUUGGAG

GUACCUGCUCUGGCAGAUUUCAACCGGGCUUGGACAGAACUUACCGACU

GGCUUUCUCUGCUUGAUCAAGUUAUAAAAUCACAGAGGGUGAUGGUGGG

UGACCUUGAGGAUAUCAACGAGAUGAUCAUCAAGCAGAAG-3'.
```

First and Second Antisense Oligonucleotide of Compound

In an embodiment of the invention, each of said first and second antisense oligonucleotides of the compound of the invention is complementary to or binds to or targets or hybridizes to or overlaps with distinct exonic splicing enhancer (ESE) and/or exon recognition sequence (ERS) sequences of dystrophin exon 51, said first antisense oligonucleotide is complementary to or binds to or targets or hybridizes to or overlaps with SEQ ID NO: 3 and said second antisense oligonucleotide is complementary to or binds to or targets or hybridizes to or overlaps with SEQ ID NO: 4. Preferably said first and second antisense oligonucleotides of the compound of the invention are distinct, more preferably the nucleotide sequence of said first and second antisense oligonucleotide are represented by a distinct SEQ ID NO. Throughout the application, unless otherwise stated, it is also encompassed by the present invention that a compound comprises or consists of a first and second antisense oligonucleotide linked to each other by a linking moiety, wherein the nucleotide sequences of said first and second antisense oligonucleotide are at least 90%, 95%, 96%, 97%, 98% or 99% identical to each other, and wherein said first and second oligonucleotide are complementary to or bind to or target or hybridize to or overlap with at least a part of two or more distinct ESE within the same exon. Preferably, said first and second antisense oligonucleotide of the compound of the invention are not represented by an identical nucleotide sequence.

ESE sequences facilitate the recognition of genuine splice sites by the spliceosome (Cartegni et al., 2002; and Cartegni et al., 2003). A subgroup of splicing factors, called the SR proteins, can bind to these ESEs and recruit other splicing factors, such as U1 and U2AF to (weakly defined) splice sites. The binding sites of the four most abundant SR proteins (SF2/ASF, SC35, SRp40 and SRp55) have been analyzed in detail and these results are implemented in ESE-finder, a web source that predicts potential binding sites for these SR proteins (Cartegni et al., 2002; and Cartegni et al., 2003). An alternative software package to identify ESE sequences is RESCUE-ESE (Fairbrother et al., 2002; and Fairbrother et al., 2004).

A person skilled in the art is aware that ESE sequences and ERS sequences could refer to different elements, i.e. different sequences within the exon, but in some cases ESE sequences and ERS sequences could refer to identical sequences.

Throughout the application, unless explicitly stated otherwise, the terms "ESE", "ERS" and "ESE and/or ERS" may be used interchangeably throughout the application.

Preferably, said "ESE and/or ERS" sequences are predicted by ESE-finder (Cartegni et al., 2002; and Cartegni et al., 2003) and/or RESCUE-ESE (Fairbrother et al., 2002; and Fairbrother et al., 2004). As defined herein, a ESE is a splicing motif whose functionality is preferably experimentally confirmed or validated using a first or a second antisense oligonucleotide binding, targeting, hybridizing or overlapping with at least part of said ESE. The same definition holds for ERS. The functionality of said ESE and/or ERS could also be validated using a compound of the invention wherein the first or the second antisense oligonucleotide binds, targets, hybridizes or overlap with at least part of said ESE and/or ERS.

Preferably said first and second antisense oligonucleotides of the compound of the invention each have a length of 8 to 37 nucleotides, more preferably of 10 to 33 nucleotides, even more preferably of 16 to 22 nucleotides, most preferably of 18 to 22 nucleotides. However, the length of said first and second oligonucleotide may be at least 8, 9, 10, 11, 12, 13, 14, 15, 16, 17, 18, 19, 20, 21, 22, 23, 24, 25, 26, 27, 28, 29, 30, 31, 32, 33, 34, 35, 36 or 37 nucleotides. In the context of the invention, the length of said first antisense oligonucleotide may be the same or may be different from the length of said second antisense oligonucleotide. Accordingly, in a preferred embodiment is provided a compound of the invention wherein a first antisense oligonucleotide is complementary to or binds to or targets or hybridizes to or overlaps with at least a part of SEQ ID NO: 3, and wherein a second antisense oligonucleotide is complementary to or binds to or targets or hybridizes to or overlaps with at least a part of SEQ ID NO: 4, wherein said at least part of SEQ ID NO: 3 has a length of 4, 5, 6, 7, 8, 9, 10 or 11 nucleotides, preferably at least 8 nucleotides, more preferably at least 10 nucleotides, and wherein said at least part of SEQ ID NO: 4 has a length of 4, 5 or 6 nucleotides, preferably at least 5 nucleotides. In a more preferred embodiment, at least part of SEQ ID NO: 3 corresponds with the full sequence of SEQ ID NO: 3 and/or at least part of SEQ ID NO: 4 corresponds with the full sequence of SEQ ID NO: 4. Preferably, said first and second antisense oligonucleotides of said compound of the invention are distinct, more preferably the nucleotide sequence of said first and second antisense oligonucleotide are represented by a distinct SEQ ID NO.

Preferably, a compound of the invention is provided wherein a first antisense oligonucleotide is represented by a nucleotide sequence comprising or consisting of a sequence that is capable of being complementary to, binding to, targeting or hybridizing to or overlapping with at least a part of SEQ ID NO: 3, and wherein a second antisense oligonucleotide is represented by a nucleotide sequence comprising or consisting of a sequence that is capable of being complementary to, binding to, targeting or hybridizing to or overlapping with at least a part of SEQ ID NO: 4. Preferably said first and second antisense oligonucleotides of the compound are distinct as defined earlier, more preferably the nucleotide sequence of said first and second antisense oligonucleotide are represented by a distinct SEQ ID NO. Said binding or targeted or hybridized part may be at least 50% of the length of said first and/or second oligonucleotide, or at least 60%, or at least 70%, or at least 80%, or at least 90% or at least 95%, or 98% and up to 100%. A first and second oligonucleotide of the compound of the invention may be represented by a nucleotide sequence, said nucleotide sequence comprising a sequence that binds, targets, hybridizes to or is complementary to or overlaps with at least a part of SEQ ID NO: 3 or 4 as defined herein and additional flanking sequences. Several types of flanking sequences may be used. Preferably, flanking sequences are used to modify the binding of a protein to said oligonucleotide, or to modify a thermodynamic property of said oligonucleotide, more preferably to modify target RNA binding affinity. In another preferred embodiment, additional flanking sequences are complementary to sequences of the dystrophin pre-mRNA which are not present in said exon. Such flanking sequences are preferably capable of binding to or targeting sequences comprising or consisting of the branchpoint and/or the splice site acceptor or donor consensus sequences of said exon. In a preferred embodiment, such flanking sequences are capable of binding to or targeting sequences comprising or consisting of sequences of an intron of the dystrophin pre-mRNA which is adjacent to said exon.

The term (reverse) complementarity is used herein to refer to a stretch of nucleic acids that can hybridise to another stretch of nucleic acids under physiological conditions. An antisense strand is generally said to be complementary to a matching sense strand. In this context, an antisense oligonucleotide is complementary to its target. Hybridization conditions are later defined herein. It is thus not absolutely required that all the bases in the region of complementarity are capable of pairing with bases in the opposing strand. For instance, when designing an antisense oligonucleotide, one may want to incorporate for instance a residue that does not base pair with the base on the complementary strand. Mismatches may to some extent be allowed, if under the circumstances in the cell, the stretch of nucleotides is capable of hybridizing to the complementary part.

In a preferred embodiment a complementary part of a first and/or second antisense oligonucleotide of the compound (either to an open, i.e. region of a dystrophin pre-mRNA exon that is not hybridized to a region of a dystrophin pre-mRNA exon, or to a closed structure, i.e. region of a dystrophin pre-mRNA exon that is hybridized to a region of a dystrophin pre-mRNA exon) comprises at least 3, and more preferably at least 4 consecutive nucleotides. The complementary regions are preferably designed such that, when combined, they are specific for an exon in a pre-mRNA. Such specificity may be created with various lengths of complementary regions as this depends on the actual sequences in other (pre-)mRNA in the system. The risk that also one or more other pre-mRNA will be able to hybridise to an oligonucleotide decreases with increasing size of said oligonucleotide. It is clear that an antisense oligonucleotide (i.e. a first and/or second antisense oligonucleotide present in the compound of the invention) comprising mismatches in the region of complementarity but that retain the capacity to hybridise to the targeted region(s) in the pre-mRNA, can be used in the present invention. However, preferably at least the complementary parts do not comprise such mismatches as these typically have a higher efficiency and a higher specificity than oligonucleotide having such mismatches in one or more complementary regions. It is thought that higher hybridisation strengths, (i.e. increasing number of interactions with the opposing strand) are favourable in increasing the efficiency of the process of interfering with the splicing machinery of the system.

Preferably, as disclosed earlier herein the compound of the invention comprising or consisting of a first and a second antisense oligonucleotide linked to each other by a linking moiety induces skipping of exon 51 of the dystrophin pre-mRNA as defined herein. In an embodiment, the first and/or second antisense oligonucleotide of the compound that are suitable for inducing single-exon skipping, the complementarity with the region targeted of a given dystrophin exon is from 90 to 100%. In general this allows for 1 or 2 mismatch(es) in an oligonucleotide of 20 nucleotides or 1 to 4 mismatches in an oligonucleotide of 40 nucleotides. Therefore, we may have 1, 2, 3, 4, 5 mismatches in an oligonucleotide of 10 to 50 nucleotides. Preferably, 0, 1 or 2 mismatches are present in an oligonucleotide of 10 to 50 nucleotides. In an oligonucleotide of 10 to 33 nucleotides, we may have 0, 1, 2 or 3 mismatches present, preferably, 0, 1 or 2 mismatches are present. In an oligonucleotide of 16 to 22 nucleotides, we may have 0, 1, 2 mismatches present, preferably 0 or 1 mismatch is present.

The structure (i.e. open and closed structures) is best analyzed in the context of the pre-mRNA wherein the exon resides. Such structure may be analyzed in the actual RNA. However, it is currently possible to predict the secondary structure of an RNA molecule (at lowest energy costs) quite well using structure-modeling programs. Non-limiting examples of a suitable program are RNA structure version 4.5 or RNA mfold version 3.5 (Zuker et al., 2003). A person skilled in the art will be able to predict, with suitable reproducibility, a likely structure of an exon, given a nucleotide sequence. Best predictions are obtained when providing such modeling programs with both said exon and flanking intron sequences. It is typically not necessary to model the structure of the entire pre-mRNA.

The open and closed structure to which an oligonucleotide (i.e. first and/or second oligonucleotide of the compound) is directed, are preferably adjacent to one another. It is thought that in this way the annealing of the oligonucleotide to the open structure induces opening of the closed structure whereupon annealing progresses into this closed structure. Through this action the previously closed structure assumes a different conformation. However, when potential (cryptic) splice acceptor and/or donor sequences are present within the targeted exon, occasionally a new exon inclusion signal is generated defining a different (neo) exon, i.e. with a different 5' end, a different 3' end, or both. This type of activity is within the scope of the present invention as the targeted exon (exon 51) is excluded from the mRNA. The presence of a new exon, containing part of the targeted exon, in the mRNA does not alter the fact that the targeted exon, as such, is excluded. The inclusion of a neo-exon can be seen as a side effect which occurs only occasionally. There are two possibilities when exon skipping is used to restore (part of) an open reading frame of dystrophin that is disrupted as a result of a mutation. One is that the neo-exon is functional in the restoration of the reading frame, whereas in the other case the reading frame is not restored. When selecting a compound comprising an oligonucleotide for restoring dystrophin reading frames by means of exon-skipping it is of course clear that under these conditions only those compounds comprising those oligonucleotide are selected that indeed result in exon-skipping that restores the dystrophin open reading frame, with or without a neo-exon.

In an embodiment a compound of the invention is provided wherein a first antisense oligonucleotide is represented by a nucleotide sequence which has at least 95% identity with a continuous stretch of at least 4, 5, 6, 7, 8, 9, 10 or 11 nucleotides, preferably at least 8 nucleotides, more preferably at least 10 nucleotides, most preferably all nucleotides of SEQ ID NO: 5, and wherein a second antisense oligonucleotide is represented by a nucleotide sequence which has at least 95% identity with a continuous stretch of at least 4, 5 or 6 nucleotides, preferably at least 5 nucleotides, more preferably all nucleotides of SEQ ID NO: 6. Preferably said first and second antisense oligonucleotides of the compound of the invention are distinct as defined earlier herein, more preferably the nucleotide sequence of said first and second antisense oligonucleotide are represented by a distinct SEQ ID NO. Said SEQ ID NO: 5 and 6 represent the reverse-complement sequence of SEQ ID NO: 3 and 4, respectively. Said continuous stretch may be interrupted by one, two, three, four or more gaps as long as the identity percentage over the whole region is at least 95%, preferably at least 96%, 97%, 98%, 99% or 100%, more preferably at least 97%.

In a preferred embodiment the invention provides a compound comprising or consisting of a first and a second antisense oligonucleotide linked to each other by a linking moiety, wherein said first antisense oligonucleotide is represented by a nucleotide sequence comprising or consisting of any one of SEQ ID NO: 14 to 197, or a fragment thereof, and wherein said second antisense oligonucleotide is represented by a nucleotide sequence comprising or consisting of any one of SEQ ID NO: 198 to 398, or a fragment thereof. Preferably said first and second antisense oligonucleotides of the compound of the invention are distinct, more preferably the nucleotide sequence of said first and second antisense oligonucleotide are represented by a distinct SEQ ID NO. Each of said first and/or second oligonucleotide of the compound may have any of the chemistries as defined later herein or combinations thereof.

Hence, said first oligonucleotide of the compound of the invention is preferably represented by a nucleotide sequence comprising or consisting of any one of SEQ ID NO: 14 to 197, i.e. SEQ ID NO: 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196 or 197, or by a nucleotide sequence comprising or consisting of a fragment of any one of SEQ ID NO: 14 to 197, i.e. SEQ ID NO: 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196 or 197. More preferably, said first oligonucleotide of the compound of the invention is represented by a nucleotide sequence comprising or consisting of SEQ ID NO: 14, 15, 16, 17 or 18, even more preferably SEQ ID NO: 14, 15, 16 or 17, even more preferably SEQ ID NO: 14 or 15, most preferably SEQ ID NO: 14, or by a nucleotide sequence comprising or consisting of a fragment of SEQ ID NO: 14, 15, 16, 17 or 18, even more preferably SEQ ID NO: 14, 15, 16 or 17, even more preferably SEQ ID NO: 14 or 15, most preferably SEQ ID NO: 14. Said second oligonucleotide of the compound of the invention is preferably represented by a nucleotide sequence comprising or consisting of any one of SEQ ID NO: 198 to 398, i.e. SEQ ID NO: 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397 or 398, or by a nucleotide sequence comprising or consisting of a fragment of any one of SEQ ID NO: 198 to 398, i.e. SEQ ID NO: 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397 or 398. More preferably, said second oligonucleotide of the compound of the invention is represented by a nucleotide sequence comprising or consisting of SEQ ID NO: 198, 199, 200 or 201, even more preferably SEQ ID NO: 198 or 199, most preferably SEQ ID NO: 198, or by a nucleotide sequence comprising or consisting of a fragment of SEQ ID NO: 198, 199, 200 or 201, even more preferably SEQ ID NO: 198 or 199, most preferably SEQ ID NO: 198. Preferably said first and second antisense oligonucleotides of the compound of the invention are distinct, more preferably the nucleotide sequence of said first and second antisense oligonucleotide are represented by a distinct SEQ ID NO. Each of said first and/or second oligonucleotide of the compound may have any of the chemistries as defined later herein or combinations thereof.

Throughout this application, unless otherwise specified, "a fragment of a SEQ ID NO:" preferably means a nucleotide sequence comprising or consisting of at least 8, 9, 10, 11, 12, 13, 14, 15, 16, 17, 18, 19 or 20 contiguous nucleotides from said SEQ ID NO, more preferably at least 10 contiguous nucleotides. As such, "a fragment of a SEQ ID NO" preferably means a nucleotide sequence which comprises or consists of said SEQ ID NO, wherein no more than 15, 14, 13, 12, 11, 10, 9, 8, 7, 6, 5, 4, 3, 2 or 1 consecutive nucleotides are missing, preferably no more than 10, even more preferably no more than 5. Alternatively, "a fragment of a SEQ ID NO:" preferably means a nucleotide sequence comprising or consisting of an amount of contiguous nucleotides from said SEQ ID NO and wherein said amount of contiguous nucleotides is at least 50%, 60%, 70%, 80%, 90%, 91%, 92%, 93%, 94%, 95; 96%, 97%, 98% or 99% of the length of said SEQ ID NO. As such, "a fragment of a SEQ ID NO" preferably means a nucleotide sequence which comprises or consists of said SEQ ID NO, wherein an amount of consecutive nucleotides are missing and wherein said amount is no more than 50%, 45%, 40%, 35%, 30%, 25%, 20%, 15%, 10%, 5%, 4%, 3%, 2% or 1%, preferably no more than 20%, more preferably no more than 10%, of the length of said SEQ ID NO.

Preferably, said fragment of a SEQ ID NO has dystrophin pre-mRNA exon 51 skipping activity.

In another preferred embodiment the invention provides a compound comprising or consisting of a first and a second antisense oligonucleotide linked to each other by a linking moiety, wherein said first antisense oligonucleotide is represented by a nucleotide sequence comprising or consisting of a nucleotide sequence which has at least 90%, 91%, 92%, 93%, 94%, 95%, 96%, 97%, 98% or 99%, preferably at least 95%, more preferably at least 97%, identity with any one of SEQ ID NO: 14 to 197, preferably SEQ ID NO: 14, 15, 16, 17 or 18, more preferably SEQ ID NO: 14, 15, 16 or 17, even more preferably SEQ ID NO: 14 or 15, most preferably SEQ ID NO: 14, and/or wherein said second antisense oligonucleotide is represented by a nucleotide sequence comprising or consisting of a nucleotide sequence which has at least 90%, 91%, 92%, 93%, 94%, 95%, 96%, 97%, 98% or 99%, preferably at least 95%, more preferably at least 97%, identity with any one of SEQ ID NO: 198 to 398, preferably SEQ ID NO: 198, 199, 200 or 201, more preferably SEQ ID NO: 198 or 199, even more preferably SEQ ID NO: 198. Preferably said first and second antisense oligonucleotides of the compound of the invention are distinct, more preferably the nucleotide sequence of said first and second antisense oligonucleotide are represented by a distinct SEQ ID NO. Preferably, said first and/or second antisense oligonucleotide has dystrophin pre-mRNA exon 51 skipping activity.

Each of said first and/or second oligonucleotide of the compound may have any of the chemistries as defined later herein or combinations thereof.

In an embodiment, the invention as such provides a compound, preferably for skipping exon 51, comprising or consisting of a first and a second antisense oligonucleotide linked to each other by a linking moiety, wherein said first antisense oligonucleotide is represented by a nucleotide sequence comprising or consisting of:

i) SEQ ID NO: 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196 or 197, preferably SEQ ID NO: 14, 15, 16, 17 or 18, more preferably SEQ ID NO: 14, 15, 16 or 17, even more preferably SEQ ID NO: 14 or 15, most preferably SEQ ID NO: 14, or ii) a fragment of SEQ ID NO: 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196 or 197, preferably SEQ ID NO: 14, 15, 16, 17 or 18, more preferably SEQ ID NO: 14, 15, 16 or 17, even more preferably SEQ ID NO: 14 or 15, most preferably SEQ ID NO: 14, or iii) SEQ ID NO: 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196 or 197, preferably SEQ ID NO: 14, 15, 16, 17 or 18, more preferably SEQ ID NO: 14, 15, 16 or 17, even more preferably SEQ ID NO: 14 or 15, most preferably SEQ ID NO: 14, with 1, 2, 3, 4, or 5 additional nucleotides or iv) SEQ ID NO: 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196 or 197, preferably SEQ ID NO: 14, 15, 16, 17 or 18, more preferably SEQ ID NO: 14, 15, 16 or 17, even more preferably SEQ ID NO: 14 or 15, most preferably SEQ ID NO: 14, with 1, 2, 3, 4, or 5 nucleotides missing from said SEQ ID NO, or v) a nucleotide sequence which has at least 90%, 91%, 92%, 93%, 94%, 95%, 96%, 97%, 98% or 99%, preferably at least 95%, more preferably at least 97%, identity with SEQ ID NO: 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196 or 197, preferably SEQ ID NO: 14, 15, 16, 17 or 18, more preferably SEQ ID NO: 14, 15, 16 or 17, even more preferably SEQ ID NO: 14 or 15, most preferably SEQ ID NO: 14;

and/or wherein said second antisense oligonucleotide is represented by a nucleotide sequence comprising or consisting of:

i) SEQ ID NO: 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397 or 398, preferably SEQ ID NO: 198, 199, 200 or 201, more preferably SEQ ID NO: 198 or 199, even more preferably SEQ ID NO: 198, or ii) a fragment of SEQ ID NO: 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397 or 398, preferably SEQ ID NO: 198, 199, 200 or 201, more preferably SEQ ID NO: 198 or 199, even more preferably SEQ ID NO: 198, or iii) SEQ ID NO: 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397 or 398, preferably SEQ ID NO: 198, 199, 200 or 201, more preferably SEQ ID NO: 198 or 199, even more preferably SEQ ID NO: 198, with 1, 2, 3, 4, or 5 additional nucleotides, or iv) SEQ ID NO: 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397 or 398, preferably SEQ ID NO: 198, 199, 200 or 201, more preferably SEQ ID NO: 198 or 199, even more preferably SEQ ID NO: 198, with 1, 2, 3, 4, or 5 nucleotides missing from said SEQ ID NO, or v) a nucleotide sequence which has at least 90%, 91%, 92%, 93%, 94%, 95%, 96%, 97%, 98% or 99%, preferably at least 95%, more preferably at least 97%, identity with SEQ ID NO: 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397 or 398, preferably SEQ ID NO: 198, 199, 200 or 201, more preferably SEQ ID NO: 198 or 199, even more preferably SEQ ID NO: 198.

Preferably said first and second antisense oligonucleotides of the compound of the invention are distinct, more preferably the nucleotide sequence of said first and second antisense oligonucleotide are represented by a distinct SEQ ID NO.

Said "1, 2, 3, 4 or 5 additional nucleotides" may be present at the 5' and/or 3' side of a given SEQ ID NO.

Said "1, 2, 3, 4 or 5 missing nucleotides" may be nucleotides missing at the 5' and/or 3' side of a given SEQ ID NO.

Each of said first and/or second oligonucleotide of the compound may have any of the chemistries as defined later herein or combinations thereof. Also in this context it is allowed to have 1 or 2 mismatch(es) in an oligonucleotide of 20 nucleotides or 1 to 4 mismatches in an oligonucleotide of 40 nucleotides as defined earlier herein. In an oligonucleotide of 10 to 33 nucleotides, 0, 1, 2 or 3 mismatches are present, preferably, 0, 1 or 2 mismatches are present, as defined earlier herein. In an oligonucleotide of 16 to 22 nucleotides, we may have 0, 1, 2 mismatches present, preferably 0 or 1 mismatch is present, as defined earlier herein.

In an embodiment, a compound of the invention is preferably for skipping exon 51 of the pre-mRNA of dystrophin. In the context of the invention, the positions of said first and second antisense oligonucleotides within the compound of the invention are interchangeable.

In a preferred embodiment, a compound of the invention is preferably for skipping exon 51 of the pre-mRNA of dystrophin, and comprises or consists of a first antisense oligonucleotide represented by a nucleotide sequence comprising or consisting of SEQ ID NO: 14, 15, 16, 17 or 18, more preferably SEQ ID NO: 14, 15, 16 or 17, even more preferably SEQ ID NO: 14 or 15, most preferably SEQ ID NO: 14, and a second antisense oligonucleotide represented by a nucleotide sequence comprising or consisting of SEQ ID NO: 198, 199, 200 or 201, more preferably SEQ ID NO: 198 or 199, even more preferably SEQ ID NO: 198, wherein said first and second antisense oligonucleotide are linked to each other by a linking moiety (as described in the section entitled "Linking moiety"), preferably said linking moiety is tri-ethylene glycol (TEG) or hexa-ethylene glycol (HEG).

Said SEQ ID NO: 14 is represented by the sequence GGUAAGUUCUGUCCAAGC, said SEQ ID NO: 15 is represented by the sequence GUAAGUUCUGUC-CAAGCC, said SEQ ID NO: 16 is represented by the sequence AGUCGGUAAGUUCUGUCC, said SEQ ID NO: 17 is represented by the sequence CUGUCCAAGCCCG-GUUGA, said SEQ ID NO: 18 is represented by the sequence UAAGUUCUGUCCAAG, said SEQ ID NO: 198 is represented by the sequence UCAAGGAAGAUGG-CAUUUCU, said SEQ ID NO: 199 is represented by the sequence UCAAGGAAGAUGGCAUUUCUAG, said SEQ ID NO: 200 is represented by the sequence UCAAGGAAGAUGGCAU and said SEQ ID NO: 201 is represented by the sequence GAAGAUGGCAUUUCU.

In the context of the invention, the positions of said first and second antisense oligonucleotides within the compound of the invention are interchangeable. As such, a preferred compound of the invention can be represented by:

i) SEQ ID NO: 16175-TEG-SEQ ID NO: 16354 (GGUAAGUUCUGUCCAAGCnUCAAGGAAGAUGGCAUUUCU) or SEQ ID NO: 16176-TEG-SEQ ID NO: 16355 (UCAAGGAAGAUGGCAUUUCUnGGUAAGUUCUGUCCAAGC), wherein the linking moiety, represented by n, is a TEG linker, or ii) SEQ ID NO: 16177-HEG-SEQ ID NO: 16356 (GGUAAGUUCUGUCCAAGCnUCAAGGAAGAUGGCAUUUCU) or SEQ ID NO: 16178-HEG-SEQ ID NO: 16357 (UCAAGGAAGAUGGCAUUUCUnGGUAAGUUCUGUCCAAGC), wherein the linking moiety, represented by n, is a HEG linker, or iii) SEQ ID NO: 16179-TEG-SEQ ID NO: 16358 (GGUAAGUUCUGUCCAAGCnUCAAGGAAGAUGGCAUUUCUAG) or SEQ ID NO: 16180-TEG-SEQ ID NO: 16359 (UCAAGGAAGAUGGCAUUUCUAGnGGUAAGUUCUGUCCAAGC), wherein the linking moiety, represented by n, is a TEG linker, or iv) SEQ ID NO: 16181-HEG-SEQ ID NO: 16360 (GGUAAGUUCUGUCCAAGCnUCAAGGAAGAUGGCAUUUCUAG) or SEQ ID NO: 16182-HEG-SEQ ID NO: 16361 (UCAAGGAAGAUGGCAUUUCUAGnGGUAAGUUCUGUCCAAGC), wherein the linking moiety, represented by n, is a HEG linker, or v) SEQ ID NO: 16183-TEG-SEQ ID NO: 16362 (GUAAGUUCUGUCCAAGCCnUCAAGGAAGAUGGCAUUUCU) or SEQ ID NO: 16184-TEG-SEQ ID NO: 16363 (UCAAGGAAGAUGGCAUUUCUnGUAAGUUCUGUCCAAGCC), wherein the linking moiety, represented by n, is a TEG linker, or vi) SEQ ID NO: 16185-HEG-SEQ ID NO: 16364 (GUAAGUUCUGUCCAAGCCnUCAAGGAAGAUGGCAUUUCU) or SEQ ID NO: 16186-HEG-SEQ ID NO: 16365 (UCAAGGAAGAUGGCAUUUCUnGUAAGUUCUGUCCAAGCC), wherein the linking moiety, represented by n, is a HEG linker, or vii) SEQ ID NO: 16187-TEG-SEQ ID NO: 16366 (GUAAGUUCUGUCCAAGCCnUCAAGGAAGAUGGCAUUUCUAG) or SEQ ID NO: 16188-TEG-SEQ ID NO: 16367 (UCAAGGAAGAUGGCAUUUCUAGnGUAAGUUCUGUCCAAGCC), wherein the linking moiety, represented by n, is a TEG linker, or viii) SEQ ID NO: 16189-HEG-SEQ ID NO: 16368 (GUAAGUUCUGUCCAAGCCnUCAAGGAAGAUGGCAUUUCUAG) or SEQ ID NO: 16190-HEG-SEQ ID NO: 16369 (UCAAGGAAGAUGGCAUUUCUAGnGUAAGUUCUGUCCAAGCC), wherein the linking moiety, represented by n, is a HEG linker, or ix) SEQ ID NO: 16191-TEG-SEQ ID NO: 16370 (AGUCGGUAAGUUCUGUCCnUCAAGGAAGAUGGCAUUUCU) or SEQ ID NO: 16192-TEG-SEQ ID NO: 16371 (UCAAGGAAGAUGGCAUUUCUnAGUCGGUAAGUUCUGUCC), wherein the linking moiety, represented by n, is a TEG linker, or x) SEQ ID NO: 16193-HEG-SEQ ID NO: 16372 (AGUCGGUAAGUUCUGUCCnUCAAGGAAGAUGGCAUUUCU) or SEQ ID NO: 16194-HEG-SEQ ID NO: 16373 (UCAAGGAAGAUGGCAUUUCUnAGUCGGUAAGUUCUGUCC), wherein the linking moiety, represented by n, is a HEG linker, or xi) SEQ ID NO: 16195-TEG-SEQ ID NO: 16374 (AGUCGGUAAGUUCUGUCCnUCAAGGAAGAUGGCAUUUCUAG) or SEQ ID NO: 16196-TEG-SEQ ID NO: 16375 (UCAAGGAAGAUGGCAUUUCUAGnAGUCGGUAAGUUCUGUCC), wherein the linking moiety, represented by n, is a TEG linker, or xii) SEQ ID NO: 16197-HEG-SEQ ID NO: 16376 (AGUCGGUAAGUUCUGUCCnUCAAGGAAGAUGGCAUUUCUAG) or SEQ ID NO: 16198-HEG-SEQ ID NO: 16377 (UCAAGGAAGAUGGCAUUUCUAGnAGUCGGUAAGUUCUGUCC), wherein the linking moiety, represented by n, is a HEG linker, or xiii) SEQ ID NO: 16199-TEG-SEQ ID NO: 16378 (CUGUCCAAGCCCGGUUGAnUCAAGGAAGAUGGCAUUUCU) or SEQ ID NO: 16200-TEG-SEQ ID NO: 16379 (UCAAGGAAGAUGGCAUUUCUnCUGUCCAAGCCCGGUUGA), wherein the linking moiety, represented by n, is a TEG linker, or xiv) SEQ ID NO: 16201-HEG-SEQ ID NO: 16380 (CUGUCCAAGCCCGGUUGAnUCAAGGAAGAUGGCAUUUCU) or SEQ ID NO: 16202-HEG-SEQ ID NO: 16381 (UCAAGGAAGAUGGCAUUUCUnCUGUCCAAGCCCGGUUGA), wherein the linking moiety, represented by n, is a HEG linker, or xv) SEQ ID NO: 16203-TEG-SEQ ID NO: 16382 (CUGUCCAAGCCCGGUUGAnUCAAGGAAGAUGGCAUUUCUAG) or SEQ ID NO: 16204-TEG-SEQ ID NO: 16383 (UCAAGGAAGAUGGCAUUUCUAGnCUGUCCAAGCCCGGUUGA), wherein the linking moiety, represented by n, is a TEG linker, or xvi) SEQ ID NO: 16205-HEG-SEQ ID NO: 16384 (CUGUCCAAGCCCGGUUGAnUCAAGGAAGAUGGCAUUUCUAG) or SEQ ID NO: 16206-HEG-SEQ ID NO: 16385 (UCAAGGAAGAUGGCAUUUCUAGnCUGUCCAAGCCCGGUUGA), wherein the linking moiety, represented by n, is a HEG linker, or xvii) SEQ ID NO: 16207-TEG-SEQ ID NO: 16386 (UAAGUUCUGUCCAAGnUCAAGGAAGAUGGCAU) or SEQ ID NO: 16208-TEG-SEQ ID NO: 16387 (UCAAGGAAGAUGGCAUnUAAGUUCUGUCCAAG), wherein the linking moiety, represented by n, is a TEG linker, or xviii) SEQ ID NO: 16209-HEG-SEQ ID NO: 16388 (UAAGUUCUGUCCAAGnUCAAGGAAGAUGGCAU) or SEQ ID NO: 16210-HEG-SEQ ID NO: 16389 (UCAAGGAAGAUGGCAUnUAAGUUCUGUCCAAG), wherein the linking moiety, represented by n, is a HEG linker, or xix) SEQ ID NO: 16211-TEG-SEQ ID NO: 16390 (UAAGUUCUGUCCAAGnGAAGAUGGCAUUUCU) or SEQ ID NO: 16212-TEG-SEQ ID NO:

16391 (GAAGAUGGCAUUUCUnUAAGUUCUGU-CCAAG), wherein the linking moiety, represented by n, is a TEG linker, or xx) SEQ ID NO: 16213-HEG-SEQ ID NO: 16392 (UAAGUUCUGUCCAAGnGAAGAUGG-CAUUUCU) or SEQ ID NO: 16214-HEG-SEQ ID NO: 16393 (GAAGAUGGCAUUUCUnU-AAGUUCUGUCCAAG), wherein the linking moiety, represented by n, is a HEG linker.

A more preferred compound of the invention is represented by any one of SEQ ID NO: 16175-TEG-16354, 16176-TEG-16355, 16179-TEG-16358, 16180-TEG-16359, 16183-TEG-16382, 16184-TEG-16363, 16187-TEG-16366, 16188-TEG-16367, 16191-TEG-16370, 16192-TEG-16371, 16195-TEG-16374, 16196-TEG-16375, 16199-TEG-16378, 16200-TEG-16379, 16203-TEG-16382 and 16204-TEG-16383 (TEG linker) or any one of SEQ ID NO: 16177-HEG-16356, 16178-HEG-16357, 16181-HEG-16360, 16182-HEG-16361, 16185-HEG-16364, 16186-HEG-16365, 16189-HEG-16368, 16190-HEG-16369, 16193-HEG-16372, 16194-HEG-16373, 16197-HEG-16376, 16198-HEG-16377, 16201-HEG-16380, 16202-HEG-16381, 16205-HEG-16384 and 16206-HEG-16385 (HEG linker).

An even more preferred compound of the invention is represented by any one of SEQ ID NO: 16191-TEG-16370, 16192-TEG-16371, 16195-TEG-16374, 16196-TEG-16375, 16199-TEG-16378, 16200-TEG-16379, 16203-TEG-16382 and 16204-TEG-16383 (TEG linker) or any one of SEQ ID NO: 16193-HEG-16372, 16194-HEG-16373, 16197-HEG-16376, 16198-HEG-16377, 16201-HEG-16380, 16202-HEG-16381, 16205-HEG-16384 and 16206-HEG-16385 (HEG linker).

An even more preferred compound of the invention is represented by any one of SEQ ID NO: 16175-TEG-16354, 16176-TEG-16355, 16179-TEG-16358, 16180-TEG-16359, 16183-TEG-16382, 16184-TEG-16363, 16187-TEG-16366 and 16188-TEG-16367 (TEG linker) or any one of SEQ ID NO: 16177-HEG-16356, 16178-HEG-16357, 16181-HEG-16360, 16182-HEG-16361, 16185-HEG-16364, 16186-HEG-16365, 16189-HEG-16368 and 16190-HEG-16369 (HEG linker).

A most preferred compound of the invention is represented by SEQ ID NO: 16175-TEG-16354 or 16176-TEG-16355 (TEG linker) or SEQ ID NO: 16177-HEG-16356 or 16178-HEG-16357 (HEG linker).

Preferred first and/or second AONs of the compound of the invention are those wherein said first and/or second oligonucleotide induces dystrophin pre-mRNA splicing modulation, preferably said pre-mRNA splicing modulation alters production or composition of protein, which preferably comprises exon skipping or exon inclusion, wherein said pre-mRNA splicing modulation most preferably comprises exon skipping. This pre-mRNA splicing modulation is preferably used in the context of a therapeutic application as later defined herein. Splicing of a pre-mRNA occurs via two sequential transesterification reactions involving an intronic branch point and a splice site of an adjacent intron.

The objective of pre-mRNA splicing modulation can be to alter production of protein, most often the protein the RNA codes for. This production can be altered through increase or decrease of the level of said production. This production can also be altered through alteration of the composition of the protein that is actually produced, for example when pre-mRNA splicing modulation results in inclusion or exclusion of one or more exons, and in a protein that has a different amino acid sequence. Preferably, such a protein with a different amino acid sequence has more functionality, or has a better functionality, or has at least one altered property, than the protein that is produced as a result of the disease or condition.

In the case of DMD, pre-mRNA splicing modulation can be applied to skip one or more specific exons in the dystrophin pre-mRNA in order to restore the open reading frame of the transcript and to induce the expression of a shorter but (more) functional dystrophin protein, with the ultimate goal to be able to interfere with the course of the disease. As such, in a preferred embodiment is provided a compound of the invention, wherein said compound induces pre-mRNA splicing modulation, wherein said pre-mRNA splicing modulation alters production of protein that is related to Duchenne Muscular Dystrophy (DMD).

In a preferred embodiment, a compound of the invention is used for inducing exon-skipping in the dystrophin pre-mRNA in a cell, in an organ, in a tissue and/or in an individual. In a more preferred embodiment, a compound of the invention is used for skipping exon 51 of the dystrophin pre-mRNA. Exon-skipping results in a mature dystrophin mRNA that does not contain a skipped exon and thus can lead to the expression of a shorter protein product. The skipping of exon 51 is preferably induced by a compound of the invention, wherein a first AON binds to a first exonic splicing enhancer (ESE), wherein the nucleotide sequence of said first ESE is represented by SEQ ID NO: 3, and wherein a second AON binds to a second exonic splicing enhancer (ESE), wherein the nucleotide sequence of said second ESE is represented by SEQ ID NO: 4.

Preferably said first and second antisense oligonucleotides of the compound of the invention are distinct, more preferably the nucleotide sequence of said first and second antisense oligonucleotide are represented by a distinct SEQ ID NO.

Throughout the application, unless mentioned otherwise, the term "binds to" can be replaced with "complementary to", "targets", "hybridizes to", "overlaps with" and/or "targets".

As defined herein a DMD pre-mRNA preferably means a pre-mRNA of a DMD gene coding for a dystrophin protein. A mutated DMD pre-mRNA corresponds to a pre-mRNA of a DMD patient with a mutation when compared to a wild type DMD pre-mRNA of a non-affected person, resulting in reduced levels or the absence of functional dystrophin (DMD). A DMD pre-mRNA is also named a dystrophin pre-mRNA. A DMD gene may also be named a dystrophin gene. Dystrophin and DMD may be used interchangeably throughout the application.

A patient is preferably intended to mean a patient having DMD as later defined herein or a patient susceptible to develop DMD due to his genetic background. In the case of a DMD patient, an oligonucleotide used will preferably correct one mutation as present in the DMD gene of said patient and create a protein that will look like a BMD protein: said protein will preferably be a functional or semi-functional dystrophin as later defined herein.

As defined herein, a functional dystrophin is preferably a wild type dystrophin corresponding to a protein having the amino acid sequence as identified in SEQ ID NO: 1. As defined herein, a semi-functional dystrophin is preferably a BMD-like dystrophin corresponding to a protein having an acting binding domain in its N terminal part (first 240 amino acids at the N terminus), a cysteine-rich domain (amino acid 3361 till 3685) and a C terminal domain (last 325 amino acids at the C terminus) each of these domains being present in a wild type dystrophin as known to the skilled person. The amino acids indicated herein correspond to amino acids of the wild type dystrophin being represented by SEQ ID NO: 1. In other words, a functional or a semi-functional dystrophin is a dystrophin which exhibits at least to some extent an activity of a wild type dystrophin. "At least to some extent" preferably means at least 10%, 20%, 30%, 40%, 50%, 60%, 70%, 80%, 90%, 95% or 100% of a corresponding activity of a wild type functional dystrophin. In this context, an activity of a functional dystrophin is preferably binding to actin and to the dystrophin-associated glycoprotein complex (DGC or DAPC) (Ehmsen J et al, 2002).

Binding of dystrophin to actin and to the DGC or DAPC complex may be visualized by either co-immunoprecipitation using total protein extracts or immunofluorescence analysis of cross-sections using various antibodies reacting with the different members of the complex, from a control (non-DMD) biopsy of one from a muscle suspected to be dystrophic, pre- and/or post-treatment, as known to the skilled person.

Individuals or patients suffering from Duchenne muscular dystrophy typically have a mutation in the gene encoding dystrophin (the DMD or dystrophin gene) that prevents synthesis of the complete protein, i.e. a premature stop codon prevents the synthesis of the C-terminus. In Becker muscular dystrophy the dystrophin gene also comprises a mutation compared to the wild type but the mutation does typically not result in a premature stop codon and the C-terminus is typically synthesized. As a result a functional or semi-functional dystrophin protein is synthesized that has at least the same activity in kind as the wild type protein, although not necessarily the same amount of activity. The genome of a BMD patient typically encodes a dystrophin protein comprising the N terminal part (first 240 amino acids at the N terminus), a cysteine-rich domain (amino acid 3361 till 3685) and a C-terminal domain (last 325 amino acids at the C-terminus) but in the majority of cases its central rod shaped domain is shorter than the one of a wild type dystrophin (Monaco et al., 1988). Antisense oligonucleotide-induced exon skipping for the treatment of DMD is typically directed to overcome a premature stop in the pre-mRNA by skipping an exon, preferably in the central rod-domain shaped domain, to correct the open reading frame and allow synthesis of remainder of the dystrophin protein including the C-terminus, albeit that the protein is somewhat smaller as a result of a smaller rod domain. In a preferred embodiment, an individual having DMD and being treated by a compound as defined herein will be provided a dystrophin which exhibits at least to some extent an activity of a wild type dystrophin. More preferably, if said individual is a Duchenne patient or is suspected to be a Duchenne patient, a functional or a semi-functional dystrophin is a dystrophin of an individual having BMD: typically said dystrophin is able to interact with both actin and the DGC or DAPC, but its central rod shaped domain may be shorter than the one of a wild type dystrophin (Monaco et al., 1988). The central rod domain of wild type dystrophin comprises 24 spectrin-like repeats. For example, a central rod shaped domain of a dystrophin as provided herein may comprise 5 to 23, 10 to 22 or 12 to 18 spectrin-like repeats as long as it can bind to actin and to DGC.

Alleviating one or more symptom(s) of Duchenne Muscular Dystrophy in an individual using a compound of the invention may be assessed by any of the following assays: prolongation of time to loss of walking, improvement of muscle strength, improvement of the ability to lift weight, improvement of the time taken to rise from the floor, improvement in the nine-meter walking time, improvement in the time taken for four-stairs climbing, improvement of the leg function grade, improvement of the pulmonary function, improvement of cardiac function, improvement of the quality of life. Each of these assays is known to the skilled person. As an example, the publication of Manzur et al. (2008), gives an extensive explanation of each of these assays. For each of these assays, as soon as a detectable improvement or prolongation of a parameter measured in an assay has been found, it will preferably mean that one or more symptoms of Duchenne Muscular Dystrophy has been alleviated in an individual using a compound of the invention. Detectable improvement or prolongation is preferably a statistically significant improvement or prolongation as described in Hodgetts et al. (2006). Alternatively, the alleviation of one or more symptom(s) of Duchenne Muscular Dystrophy may be assessed by measuring an improvement of a muscle fiber function, integrity and/or survival. In a preferred method, one or more symptom(s) of a DMD patient is/are alleviated and/or one or more characteristic(s) of one or more muscle cells from a DMD patient is/are improved. Such symptoms or characteristics may be assessed at the cellular, tissue level or on the patient self.

An alleviation of one or more characteristics of a muscle cell from a patient may be assessed by any of the following assays on a myogenic cell or muscle cell from a patient: reduced calcium uptake by muscle cells, decreased collagen synthesis, altered morphology, altered lipid biosynthesis, decreased oxidative stress, and/or improved muscle fiber function, integrity, and/or survival. These parameters are usually assessed using immunofluorescence and/or histochemical analyses of cross sections of muscle biopsies.

The improvement of muscle fiber function, integrity and/or survival may be assessed using at least one of the following assays: a detectable decrease of creatine kinase in blood, a detectable decrease of necrosis of muscle fibers in a biopsy cross-section of a muscle suspected to be dystrophic, and/or a detectable increase of the homogeneity of the diameter of muscle fibers in a biopsy cross-section of a muscle suspected to be dystrophic. Each of these assays is known to the skilled person.

Creatine kinase may be detected in blood as described in Hodgetts et al. (2006). A detectable decrease in creatine kinase may mean a decrease of 5%, 10%, 20%, 30%, 40%, 50%, 60%, 70%, 80%, 90% or more compared to the concentration of creatine kinase in a same DMD patient before treatment.

A detectable decrease of necrosis of muscle fibers is preferably assessed in a muscle biopsy, more preferably as described in Hodgetts et al. (2006), using biopsy cross-sections. A detectable decrease of necrosis may be a decrease of 5%, 10%, 20%, 30%, 40%, 50%, 60%, 70%, 80%, 90% or more of the area wherein necrosis has been identified using biopsy cross-sections. The decrease is measured by comparison to the necrosis as assessed in a same DMD patient before treatment.

A detectable increase of the homogeneity of the diameter of a muscle fiber is preferably assessed in a muscle biopsy cross-section, more preferably as described in Hodgetts et al. (2006). The increase is measured by comparison to the homogeneity of the diameter of a muscle fiber in a same DMD patient before treatment.

Preferably, a compound of the invention provides said individual with a functional or a semi-functional dystrophin protein, and is able to, for at least in part decrease the production of an aberrant dystrophin protein in said individual.

In the context of the invention, providing an individual with a functional or a semi-functional dystrophin protein means an increase in the production of functional or semi-functional dystrophin protein as earlier defined herein. Increasing the production of functional or semi-functional dystrophin mRNA, or functional or semi-functional dystrophin protein, preferably means a detectable increase or at least 5%, 10%, 20%, 30%, 40%, 50%, 60%, 70%, 80%, 90%, 100%, 120%, 140%, 160%, 180%, 200% or more compared to the initial amount of functional or semi-functional mRNA, or functional or semi-functional dystrophin protein, as detectable by RT-digital droplet PCR (mRNA) (Verheul et al., 2016) or immunofluorescence (Beekman et al., 2014), western blot, or capillary Western immunoassay (Wes; Beekman et al., 2018) analysis (protein). In the context of the invention, said initial amount is the amount of functional or semifunctional mRNA, or functional or semi-functional dystrophin protein, at the onset of inducing exon-skipping in the dystrophin pre-mRNA in a cell, in an organ, in a tissue and/or in an individual using a compound of the invention.

Decreasing the production of an aberrant dystrophin mRNA, or aberrant dystrophin protein, preferably means that 90%, 80%, 70%, 60%, 50%, 40%, 30%, 20%, 10%, 5% or less of the initial amount of aberrant dystrophin mRNA, or aberrant dystrophin protein, is still detectable by RT-digital droplet PCR (mRNA) or immunofluorescence, western blot, or capillary Western immunoassay (Wes) analysis (protein). In the context of the invention, said initial amount is the amount of aberrant dystrophin mRNA, or aberrant dystrophin protein, at the onset of inducing exon-skipping in the dystrophin pre-mRNA in a cell, in an organ, in a tissue and/or in an individual using a compound of the invention. An aberrant dystrophin mRNA or protein is also referred to herein as a less functional (compared to a wild type functional dystrophin protein as earlier defined herein) or a non-functional dystrophin mRNA or protein. A non-functional dystrophin protein is preferably a dystrophin protein which is not able to bind actin and/or members of the DGC protein complex. A non-functional dystrophin protein or dystrophin mRNA does typically not have, or does not encode a dystrophin protein with an intact C-terminus of the protein. The detection of a functional or semi-functional dystrophin mRNA or protein may be done as for an aberrant dystrophin mRNA or protein.

Once a DMD patient is provided with a functional or a semi-functional dystrophin protein, at least part of the cause of DMD is taken away. Hence, it would then be expected that the symptoms of DMD are at least partly alleviated, or that the rate with which the symptoms worsen is decreased, resulting in a slower decline. The enhanced skipping frequency also increases the level of functional or a semi-functional dystrophin protein produced in a muscle cell of a DMD individual.

Within the context of the invention, a first and/or second oligonucleotide of the compound of the invention may comprise a functional equivalent of an oligonucleotide. A functional equivalent of an oligonucleotide preferably means an oligonucleotide as defined herein (i.e. a first and/or second antisense oligonucleotide present in the compound of the invention) wherein one or more nucleotides have been substituted and wherein an activity of said functional equivalent is retained to at least some extent. Preferably, an activity of said oligonucleotide comprising a functional equivalent of an oligonucleotide is providing a functional or a semi-functional dystrophin protein. Said activity of said oligonucleotide comprising a functional equivalent of an oligonucleotide is therefore preferably assessed by quantifying the amount of a functional or a semi-functional dystrophin protein. A functional or semi-functional dystrophin is herein preferably defined as being a dystrophin able to bind actin and members of the DGC (or DAPC) protein complex. The assessment of said activity of said functional equivalent of an oligonucleotide is preferably done by RT-digital droplet PCR and sequencing (on RNA level; for detection of specific exon skipping (DMD)), or by immunofluorescence, Western blot, or capillary Western immunoassay (Wes) analyses (on protein level: for detection of protein restoration). Said activity is preferably retained to at least some extent when it represents at least 50%, or at least 60%, or at least 70% or at least 80% or at least 90% or at least 95% or more of corresponding activity of said oligonucleotide the functional equivalent derives from. Throughout this application, when the word "oligonucleotide" is used it may be replaced by a "functional equivalent" thereof as defined herein.

Chemical Modifications of the First and/or Second Antisense Oligonucleotide of the Compound It is to be understood in the context of the present invention that a first and/or or a second oligonucleotide of the compound comprises or consists of any chemical modification, or any combination thereof, as described in the present paragraph ("Chemical modifications of the first and/or second antisense oligonucleotide of the compound") has an exon skipping activity that is at least as good as its unmodified counterpart as described in the paragraph "First and second antisense oligonucleotide of compound" above, preferably said exon skipping activity is higher than said unmodified counterpart. As such, a compound of the invention wherein said first and/or second antisense oligonucleotide comprises or consists of any chemical modification, or any combination thereof, as described in the present paragraph ("Chemical modifications of the first and/or second antisense oligonucleotide of the compound") has an exon skipping activity that is at least as good as said compound without said chemical modification or combination thereof. Preferably, said exon skipping activity is higher than said compound without said chemical modification or combination thereof.

In an embodiment of the invention, said first and/or second antisense oligonucleotide of the compound comprises a 2'-substituted monomer, preferably a 2'-substituted RNA monomer. For oligonucleotides as described in this application, when a feature of a monomer is not defined and is not apparent from context, the corresponding feature from an RNA monomer is to be assumed.

In a preferred embodiment, said first and/or second oligonucleotide of the compound is single stranded. The skilled person will understand that it is however possible that a single stranded oligonucleotide may form an internal double stranded structure. However, this oligonucleotide is still named a single stranded oligonucleotide in the context of this invention. A single stranded oligonucleotide has several advantages compared to a double stranded siRNA oligonucleotide: (i) its synthesis is expected to be easier than two complementary siRNA strands; (ii) there is a wider range of chemical modifications possible to enhance uptake in cells, a better (physiological) stability and to decrease potential generic adverse effects; (iii) siRNAs have a higher potential for non-specific effects (including off-target genes) and exaggerated pharmacology (e.g. less control possible of effectiveness and selectivity by treatment schedule or dose) and (iv) siRNAs are less likely to act in the nucleus and cannot be directed against introns.

Preferred first and/or second oligonucleotides of the compound of the invention have a length of less than 38 nucleotides. Said first and/or second oligonucleotide may have 8, 9, 10, 11, 12, 13, 14, 15, 16, 17, 18, 19, 20, 21, 22, 23, 24, 25, 26, 27, 28, 29, 30, 31, 32, 33, 34, 35, 36 or 37 nucleotides. Such an oligonucleotide may also be identified as an oligonucleotide having from 8 to 37 nucleotides. More preferred first and/or second oligonucleotides of the compound of the invention have a length from 10 to 33 nucleotides. Even more preferred first and/or second oligonucleotides of the compound of the invention have a length of 16, 17, 18, 19, 20, 21, or 22 nucleotides. Most preferred first and/or second oligonucleotides of the compound of the invention have a length of 18, 19, 20, 21 or 22 nucleotides and may be identified as an oligonucleotide having from 18 to 22 nucleotides.

As such, in this aspect the invention provides a compound wherein said first and/or second antisense oligonucleotide comprises:
i) at least one 2'-substituted monomer and optionally a phosphorothioate backbone linkage, and/or
ii) a 5-methylcytosine and/or a 5-methyluracil base, and/or
iii) at least one monomer comprising a bicyclic nucleic acid (BNA) scaffold modification.

A compound of the invention is preferably for use as a medicament for treating a disease or condition through splice modulation, such as through exon skipping, or exon inclusion, both of which are forms of splice switching. Preferably, exon 51 of dystrophin pre-mRNA is skipped. More preferably, exon 51 of human dystrophin pre-mRNA is skipped. A preferred disease in this context is Duchenne Muscular Dystrophy (DMD).

Preferably, said monomers are RNA monomers, or are derived from RNA monomers. As such, in a preferred compound said first and/or second antisense oligonucleotide comprises:
i) at least one 2'-substituted monomer, preferably a RNA monomer or a 2'-O-substituted RNA monomer and optionally a phosphorothioate backbone linkage, and/or
ii) a 5-methylcytosine and/or a 5-methyluracil base, and/or
iii) at least one monomer comprising a bicyclic nucleic acid (BNA) scaffold modification.

Encompassed by the above ((i)) are oligonucleotides (i.e. a first and/or second antisense oligonucleotide present in the compound of the invention) that comprise at least one 2'-substituted monomer, preferably a 2'-substituted RNA monomer, and no phosphorothioate backbone linkage. Such an oligonucleotide can have a backbone that only comprises phosphodiester linkages. Similarly encompassed are oligonucleotides (i.e. a first and/or second antisense oligonucleotide present in the compound of the invention) that comprise at least one 2'-substituted monomer, preferably a 2'-substituted RNA monomer, and one or more phosphorothioate backbone linkages. Also encompassed are oligonucleotides (i.e. a first and/or second antisense oligonucleotide present in the compound of the invention) that comprise no other monomers than 2'-substituted RNA monomers, and that comprise only backbone linkages that are phosphorothioate backbone linkages. Similarly encompassed are oligonucleotides (i.e. a first and/or second antisense oligonucleotide present in the compound of the invention) that comprise no other monomers than 2'-substituted RNA monomers, and that comprise only backbone linkages that are phosphodiester backbone linkages.

As such, in a more preferred compound said first and/or second antisense oligonucleotide comprises:
i) only 2'-substituted monomers, preferably RNA monomers or 2'-O-substituted RNA monomers, linked by phosphorothioate backbone linkages and/or by phosphodiester linkages, and/or
ii) a 5-methylcytosine and/or a 5-methyluracil base, and/or
iii) at least one monomer comprising a bicyclic nucleic acid (BNA) scaffold modification.

As known to the skilled person, an oligonucleotide such as an RNA oligonucleotide generally consists of repeating monomers. Such a monomer is most often a nucleotide or a nucleotide analogue. The most common naturally occurring nucleotides in RNA are adenosine monophosphate, cytidine monophosphate, guanosine monophosphate, thymidine monophosphate, and uridine monophosphate. These consist of a pentose sugar ribose, a 5'-linked phosphate group which is linked via a phosphate ester, and a 1'-linked base. The sugar connects the base and the phosphate, and is therefore often referred to as the scaffold of the nucleotide. A modification in the pentose sugar is therefore often referred to as a scaffold modification. For severe modifications, the original pentose sugar might be replaced in its entirety by another moiety that similarly connects the base and the phosphate. It is therefore understood that while a pentose sugar is often a scaffold, a scaffold is not necessarily a pentose sugar.

A base, sometimes called a nucleobase, is generally adenine, cytosine, guanine, thymine, or uracil, or a derivative thereof. Cytosine, thymine, and uracil are pyrimidine bases, and are generally linked to the scaffold through their 3'-nitrogen. Adenine and guanine are purine bases, and are generally linked to the scaffold through their 9'-nitrogen.

A nucleotide is generally connected to neighbouring nucleotides through condensation of its 5'-phosphate moiety to the 3'-hydroxyl moiety of the neighbouring nucleotide monomer. Similarly, its 3'-hydroxyl moiety is generally connected to the 5'-phosphate of a neighbouring nucleotide monomer. This forms phosphodiester bonds. The phosphodiesters and the scaffold form an alternating copolymer. The bases are grafted to this copolymer, namely to the scaffold moieties. Because of this characteristic, the alternating copolymer formed by linked monomers of an oligonucleotide is often called the backbone of the oligonucleotide. Because the phosphodiester bonds connect neighbouring monomers together, they are often referred to as backbone linkages. It is understood that when a phosphate group is modified so that it is instead an analogous moiety such as a phosphorothioate, such a moiety is still referred to as the backbone linkage of the monomer. This is referred to as a backbone linkage modification. In general terms, the backbone of an oligonucleotide is thus comprised of alternating scaffolds and backbone linkages.

Preferably, a first and/or second antisense oligonucleotide of the compound of the invention comprises or consists of a 2'-substituted phosphorothioate monomer, preferably a 2'-substituted phosphorothioate RNA monomer, 2'-substituted phosphate RNA monomer, or 2'-substituted mixed phosphate/phosphorothioate RNA monomers. Such oligonucleotide comprises a 2'-substituted RNA monomer connected through or linked by a phosphorothioate or phosphate backbone linkage, or a mixture thereof, or consists of 2'-substituted phosphorothioate RNA, 2'-substituted phosphate RNA or a mixture thereof. More preferably, such oligonucleotide consists of 2'-substituted phosphorothioate RNA monomers, 2'-substituted phosphate RNA monomers, or a mixture thereof. The 2'-substituted RNA preferably is 2'-F, 2'-O-methyl, or 2'-O-(2-methoxyethyl). The 2'-O-(2-methoxyethyl) moiety is often referred to as 2'-MOE. More preferably, the 2'-substituted RNA monomer is a 2'-O-methyl RNA monomer. Such chemistries are known to the skilled person. In a preferred embodiment of this aspect there is provided a compound of the invention wherein said 2'-substituted monomer of said first and/or second oligonucleotide is a 2'-substituted RNA monomer, a 2'-F monomer, a 2'-amino monomer, a 2'-O-substituted monomer, a 2'-O-methyl monomer, or a 2'-O-(2-methoxyethyl) monomer, preferably a 2'-O-methyl monomer. Preferably, said 2'-substituted monomer is a 2'-substituted RNA monomer, such as a 2'-O-methyl RNA monomer.

Throughout the application, an oligonucleotide comprising a 2'-O-methyl monomer, or a 2'-O-methyl RNA monomer and a phosphorothioate, phosphate or mixed phosphate/phosphorothioate backbone linkages may be replaced respectively by an oligonucleotide comprising a 2'-O-methyl phosphorothioate RNA, 2'-O-methyl phosphate RNA or 2'-O-methyl phosphate/phosphorothioate RNA. Throughout the application, an oligonucleotide consisting of 2'-O-methyl RNA monomers linked by or connected through phosphorothioate, phosphate or mixed phosphate/phosphorothioate backbone linkages may be replaced by an oligonucleotide consisting of 2'-O-methyl phosphorothioate RNA, 2'-O-methyl phosphate RNA or 2'-O-methyl phosphate/phosphorothioate RNA.

In addition, the first and/or second antisense oligonucleotide of the compound of the invention preferably comprises a base modification that increases binding affinity to target strands, increases melting temperature of the resulting duplex of said oligonucleotide with its target, and/or decreases immunostimulatory effects, and/or increases biostability, and/or improves biodistribution and/or intra-tissue distribution, and/or cellular uptake and trafficking. In a more preferred embodiment, said first and/or second oligonucleotide comprises a 5-methylpyrimidine. A 5-methylpyrimidine is selected from a 5-methylcytosine and/or a 5-methyluracil and/or a thymine, in which thymine is identical to 5-methyluracil. 'Thymine' and '5-methyluracil' may be interchanged throughout the document. The expression "oligonucleotide comprises a 5-methylpyrimidine" means that at least one of the cytosine nucleobases of said oligonucleotide has being modified by substitution of the hydrogen at the 5-position of the pyrimidine ring with a methyl group, i.e. a 5-substituted cytosine, and/or that at least one of the uracil nucleobases of said oligonucleotide has been modified by substitution of the proton at the 5-position of the pyrimidine ring with a methyl group (i.e. a 5-methyluracil). Within the context of the invention, the expression "the substitution of a hydrogen with a methyl group in position 5 of the pyrimidine ring" may be replaced by the expression "the substitution of a pyrimidine with a 5-methylpyrimidine," with pyrimidine referring to only uracil, only cytosine, or both. If said oligonucleotide comprises 1, 2, 3, 4, 5, 6, 7, 8, 9, or more cytosines and/or uracils, at least 1, 2, 3, 4, 5, 6, 7, 8 9, or more cytosines and/or uracils respectively have been modified this way. Needless to say, the invention could therefore only be applied to oligonucleotides comprising at least one cytosine or uracil, respectively, in their sequence.

Preferably, said first and/or second antisense oligonucleotide of the compound of the invention comprise at least one of either a 5-methylcytosine base or a 5-methyluracil base. In a preferred embodiment of the invention said first and/or second antisense oligonucleotide of said compound is provided wherein all cytosine bases are 5-methylcytosine bases and/or wherein all uracil bases are 5-methyluracil bases.

This relates to oligonucleotides that comprise 5-methylcytosine but no unsubstituted cytosine or uracil, to oligonucleotides that comprise 5-methyluracil but no unsubstituted cytosine or uracil, and to oligonucleotides that comprise both 5-methylcytosine and 5-methyluracil but no unsubstituted cytosine or uracil. It also relates to oligonucleotides that comprise 5-methylcytosine but no unsubstituted cytosine yet that comprise unsubstituted uracil, or to oligonucleotides that comprise 5-methyluracil but no unsubstituted uracil, yet that comprise unsubstituted cytosine. In a more preferred embodiment of the invention said first and/or second antisense oligonucleotide is provided wherein all cytosine bases are 5-methylcytosine.

When said first oligonucleotide of the compound of the invention is represented by a nucleotide sequence comprising or consisting of a sequence represented by any one of SEQ ID NO: 14 to 197, or a fragment thereof as earlier defined herein, preferably at least one 5-methylcytosine and/or 5-methyluracil is comprised in said first oligonucleotide, more preferably all cytosine bases are 5-methylcytosine and/or all uracil bases are 5-methyluracil. As such, preferred variants of said first oligonucleotide of the compound of the invention comprise or consist of a sequence represented by any one of SEQ ID NO: 14 to 197, or a fragment thereof as earlier defined herein, are those wherein:
  all cytosine bases are 5-methylcytosine as represented by any one of SEQ ID NO: 399 to 581, or wherein
  all uracil bases are 5-methyluracil as represented by any one of SEQ ID NO: 774 to 957, or wherein
  all cytosine bases are 5-methylcytosine and all uracil bases are 5-methyluracil as represented by any one of SEQ ID NO: 1156 to 1338.

When said second oligonucleotide of the compound of the invention is represented by a nucleotide sequence comprising or consisting of a sequence represented by any one of SEQ ID NO: 198 to 398, or a fragment thereof as earlier defined herein, preferably at least one 5-methylcytosine and/or 5-methyluracil is comprised in said second oligonucleotide, more preferably all cytosine bases are 5-methylcytosine and/or all uracil bases are 5-methyluracil. As such, preferred variants of said second oligonucleotide of the compound of the invention comprise or consist of a sequence represented by any one of SEQ ID NO: 198 to 398, or a fragment thereof as earlier defined herein, are those wherein:
  all cytosine bases are 5-methylcytosine as represented by any one of SEQ ID NO: 582 to 773, or wherein
  all uracil bases are 5-methyluracil as represented by any one of SEQ ID NO: 958 to 1155, or wherein
  all cytosine bases are 5-methylcytosine and all uracil bases are 5-methyluracil as represented by any one of SEQ ID NO: 1339 to 1528.

In a more preferred embodiment, a compound of the invention is preferably for skipping exon 51 of the pre-mRNA of dystrophin, and comprises or consists of a first antisense oligonucleotide represented by a nucleotide sequence comprising or consisting of SEQ ID NO: 399, 400, 401, 402 or 403, more preferably SEQ ID NO: 399, 400, 401 or 402, even more preferably SEQ ID NO: 399 or 400, most preferably SEQ ID NO: 399, and a second antisense oligonucleotide represented by a nucleotide sequence comprising or consisting of SEQ ID NO: 582, 583, 584 or 585, more preferably SEQ ID NO: 582 or 583, even more preferably SEQ ID NO: 582, wherein said first and second antisense oligonucleotide are linked to each other by a linking moiety (as described in the section entitled "Linking moiety"), preferably said linking moiety is tri-ethylene glycol (TEG) or hexa-ethylene glycol (HEG).

Said SEQ ID NO: 399 is represented by the sequence GGUAAGUUC*UGUC*C*AAGC*, said SEQ ID NO: 400 is represented by the sequence GUAAGUUC*UGUC*C*AAGC*C*, said SEQ ID NO: 401 is represented by the sequence AGUC*GGUAAGUUC*UGUC*C*, said SEQ ID NO: 402 is represented by the sequence C*UGUC*C*AAGC*C*C*GGUUGA, said SEQ ID NO: 403 is represented by the sequence UAAGUUC*UGUC*C*AAG, said SEQ ID NO: 582 is represented by the sequence UC*AAGGAAGAUGGC*AUUUC*U, said SEQ ID NO: 583 is represented by the sequence UC*AAGGAAGAUGGC*AUUUC*UAG, said SEQ ID NO: 584 is represented by the sequence UC*AAGGAAGAUGGC*AU and said SEQ ID NO: 585 is represented by the sequence GAAGAUGGC*AUUUC*U, wherein C* is 5-methylcytosine.

Throughout this application, unless otherwise specified, C* means a 5-methylcytosine base.

In the context of the invention, the positions of said first and second antisense oligonucleotides within the compound of the invention are interchangeable. As such, a preferred compound of the invention can be represented by:

i) SEQ ID NO: 16215-TEG-SEQ ID NO: 16394 (GGUAAGUUC*UGUC*C*AAGC*nUC*AAGGAAGAUGGC*AUUUC*U) or SEQ ID NO: 16216-TEG-SEQ ID NO: 16395 (UC*AAGGAAGAUGGC*AUUUC*UnGGUAAGUUC*UGUC*C*AAGC), wherein the linking moiety, represented by n, is a TEG linker, or ii) SEQ ID NO: 16217-HEG-SEQ ID NO: 16396 (GGUAAGUUC*UGUC*C*AAGC*nUC*AAGGAAGAUGGC*AUUUC*U) or SEQ ID NO: 16218-HEG-SEQ ID NO: 16397 (UC*AAGGAAGAUGGC*AUUUC*UnGGUAAGUUC*UGUC*C*AAGC*), wherein the linking moiety, represented by n, is a HEG linker, or iii) SEQ ID NO: 16219-TEG-SEQ ID NO: 16398 (GGUAAGUUC*UGUC*C*AAGC*nUC*AAGGAAGAUGGC*AUUUC*UAG) or SEQ ID NO: 16220-TEG-SEQ ID NO: 16399 (UC*AAGGAAGAUGGC*AUUUC*UAGnGGUAAGUUC*UGUC*C*AAGC*), wherein the linking moiety, represented by n, is a TEG linker, or iv) SEQ ID NO: 16221-HEG-SEQ ID NO: 16400 (GGUAAGUUC*UGUC*C*AAGC*nUC*AAGGAAGAUGGC*AUUUC*UAG) or SEQ ID NO: 16222-HEG-SEQ ID NO: 16401 (UC*AAGGAAGAUGGC*AUUUC*UAGnGGUAAGUUC*UGUC*C*AAGC*), wherein the linking moiety, represented by n, is a HEG linker, or v) SEQ ID NO: 16223-TEG-SEQ ID NO: 16402 (GUAAGUUC*UGUC*C*AAGC*C*nUC*AAGGAAGAUGGC*AUUUC*U) or SEQ ID NO: 16224-TEG-SEQ ID NO: 16403 (UC*AAGGAAGAUGGC*AUUUC*UnGUAAGUUC*UGUC*C*AAGC*C*), wherein the linking moiety, represented by n, is a TEG linker, or vi) SEQ ID NO: 16225-HEG-SEQ ID NO: 16404 (GUAAGUUC*UGUC*C*AAGC*C*nUC*AAGGAAGAUGGC*AUUUC*U) or SEQ ID NO: 16226-HEG-SEQ ID NO: 16405 (UC*AAGGAAGAUGGC*AUUUC*UnGUAAGUUC*UGUC*C*AAGC*C*), wherein the linking moiety, represented by n, is a HEG linker, or vii) SEQ ID NO: 16227-TEG-SEQ ID NO: 16406 (GUAAGUUC*UGUC*C*AAGC*C*nUC*AAGGAAGAUGGC*AUUUC*UA G) or SEQ ID NO: 16228-TEG-SEQ ID NO: 16407 (UC*AAGGAAGAUGGC*AUUUC*UAGnGUAAGUUC*UGUC*C*AAGC*C*), wherein the linking moiety, represented by n, is a TEG linker, or viii) SEQ ID NO: 16229-HEG-SEQ ID NO: 16408 (GUAAGUUC*UGUC*C*AAGC*C*nUC*AAGGAAGAUGGC*AUUUC*UA G) or SEQ ID NO: 16230-HEG-SEQ ID NO: 16409 (UC*AAGGAAGAUGGC*AUUUC*UAGnGUAAGUUC*UGUC*C*AAGC*C*), wherein the linking moiety, represented by n, is a HEG linker, or ix) SEQ ID NO: 16231-TEG-SEQ ID NO: 16410 (AGUC*GGUAAGUUC*UGUC*C*nUC*AAGGAAGAUGGC*AUUUC*U) or SEQ ID NO: 16232-TEG-SEQ ID NO: 16411 (UC*AAGGAAGAUGGC*AUUUC*UnAGUC*GGUAAGUUC*UGUC*C*), wherein the linking moiety, represented by n, is a TEG linker, or x) SEQ ID NO: 16233-HEG-SEQ ID NO: 16412 (AGUC*GGUAAGUUC*UGUC*C*nUC*AAGGAAGAUGGC*AUUUC*U) or SEQ ID NO: 16234-HEG-SEQ ID NO: 16413 (UC*AAGGAAGAUGGC*AUUUC*UnAGUC*GGUAAGUUC*UGUC*C*), wherein the linking moiety, represented by n, is a HEG linker, or xi) SEQ ID NO: 16235-TEG-SEQ ID NO: 16414 (AGUC*GGUAAGUUC*UGUC*C*nUC*AAGGAAGAUGGC*AUUUC*UAG) or SEQ ID NO: 16236-TEG-SEQ ID NO: 16415 (UC*AAGGAAGAUGGC*AUUUC*UAGnAGUC*GGUAAGUUC*UGUC*C*), wherein the linking moiety, represented by n, is a TEG linker, or xii) SEQ ID NO: 16237-HEG-SEQ ID NO: 16416 (AGUC*GGUAAGUUC*UGUC*C*nUC*AAGGAAGAUGGC*AUUUC*UAG) or SEQ ID NO: 16238-HEG-SEQ ID NO: 16417 (UC*AAGGAAGAUGGC*AUUUC*UAGnAGUC*GGUAAGUUC*UGUC*C*), wherein the linking moiety, represented by n, is a HEG linker, or xiii) SEQ ID NO: 16239-TEG-SEQ ID NO: 16418 (C*UGUC*C*AAGC*C*C*GGUUGAnUC*AAGGAAGAUGGC*AUUUC*U) or SEQ ID NO: 16240-TEG-SEQ ID NO: 16419 (UC*AAGGAAGAUGGC*AUUUC*UnC*UGUC*C*AAGC*C*C*GGUUGA), wherein the linking moiety, represented by n, is a TEG linker, or xiv) SEQ ID NO: 16241-HEG-SEQ ID NO: 16420 (C*UGUC*C*AAGC*C*C*GGUUGAnUC*AAGGAAGAUGGC*AUUUC*U) or SEQ ID NO: 16242-HEG-SEQ ID NO: 16421 (UC*AAGGAAGAUGGC*AUUUC*UnC*UGUC*C*AAGC*C*C*GGUUGA), wherein the linking moiety, represented by n, is a HEG linker, or xv) SEQ ID NO: 16243-TEG-SEQ ID NO: 16422 (C*UGUC*C*AAGC*C*C*GGUUGAnUC*AAGGAAGAUGGC*AUUUC*U AG) or SEQ ID NO: 16244-TEG-SEQ ID NO: 16423 (UC*AAGGAAGAUGGC*AUUUC*UAGnC*UGUC*C*AAGC*C*C*GGUU GA), wherein the linking moiety, represented by n, is a TEG linker, or xvi) SEQ ID NO: 16245-HEG-SEQ ID NO: 16424 (C*UGUC*C*AAGC*C*C*GGUUGAnUC*AAGG AAGAUGGC*AUUUC*U AG) or SEQ ID NO: 16246-HEG-SEQ ID NO: 16425 (UC*AAGGAAGAUGGC*AUUUC*UAGnC*UGU C*C*AAGC*C*C*GGUU GA), wherein the linking moiety, represented by n, is a HEG linker, or xvii) SEQ ID NO: 16247-TEG-SEQ ID NO: 16426 (UAAGUUC*UGUC*C*AAGnUC*AAGGAAGAU GGC*AU) or SEQ ID NO: 16248-TEG-SEQ ID NO: 16427 (UC*AAGGAAGAUGGC*AUnUAAGUUC*UGU C*C*AAG), wherein the linking moiety, represented by n, is a TEG linker, or xviii) SEQ ID NO: 16249-HEG-SEQ ID NO: 16428 (UAAGUUC*UGUC*C*AAGnUC*AAGGAAGAU GGC*AU) or SEQ ID NO: 16250-HEG-SEQ ID NO: 16429 (UC*AAGGAAGAUGGC*AUnUAAGUUC*UGU C*C*AAG), wherein the linking moiety, represented by n, is a HEG linker, or xix) SEQ ID NO: 16251-TEG-SEQ ID NO: 16430 (UAAGUUC*UGUC*C*AAGnGAAGAUGGC*AU UUC*U) or SEQ ID NO: 16252-TEG-SEQ ID NO: 16431 (GAAGAUGGC*AUUUC*UnUAAGUUC*UGUC* C*AAG), wherein the linking moiety, represented by n, is a TEG linker, or xx) SEQ ID NO: 16253-HEG-SEQ ID NO: 16432 (UAAGUUC*UGUC*C*AAGnGAAGAUGGC*AU UUC*U) or SEQ ID NO: 16254-HEG-SEQ ID NO: 16433 (GAAGAUGGC*AUUUC*UnUAAGUUC*UGUC* C*AAG), wherein the linking moiety, represented by n, is a HEG linker, wherein C* is 5-methylcytosine.

A more preferred compound of the invention is represented by any one of SEQ ID NO: 16215-TEG-16394, 16216-TEG-16395, 16219-TEG-16398, 16220-TEG-16399, 16223-TEG-16402, 16224-TEG-16403, 16227-TEG-16406, 16228-TEG-16407, 16231-TEG-16410, 16232-TEG-16411, 16235-TEG-16414, 16236-TEG-16415, 16239-TEG-16418, 16240-TEG-16419, 16243-TEG-16422 and 16244-TEG-16423 (TEG linker) or any one of SEQ ID NO: 16217-HEG-16396, 16218-HEG-16397, 16221-HEG-16400, 16222-HEG-16401, 16225-HEG-16404, 16226-HEG-16405, 16229-HEG-16408, 16230-HEG-16409, 16233-HEG-16412, 16234-HEG-16413, 16237-HEG-16416, 16238-HEG-16417, 16241-HEG-16420, 16242-HEG-16421, 16245-HEG-16424 and 16246-HEG-16425 (HEG linker).

An even more preferred compound of the invention is represented by any one of SEQ ID NO: 16231-TEG-16410, 16232-TEG-16411, 16235-TEG-16414, 16236-TEG-16415, 16239-TEG-16418, 16240-TEG-16419, 16243-TEG-16422 and 16244-TEG-16423 (TEG linker) or any one of SEQ ID NO: 16233-HEG-16412, 16234-HEG-16413, 16237-HEG-16416, 16238-HEG-16417, 16241-HEG-16420, 16242-HEG-16421, 16245-HEG-16424 and 16246-HEG-16425 (HEG linker).

An even more preferred compound of the invention is represented by any one of SEQ ID NO: 16215-TEG-16394, 16216-TEG-16395, 16219-TEG-16398, 16220-TEG-16399, 16223-TEG-16402, 16224-TEG-16403, 16227-TEG-16406 and 16228-TEG-16407 (TEG linker) or any one of SEQ ID NO: 16217-HEG-16396, 16218-HEG-16397, 16221-HEG-16400, 16222-HEG-16401, 16225-HEG-16404, 16226-HEG-16405, 16229-HEG-16408 and 16230-HEG-16409 (HEG linker).

A most preferred compound of the invention is represented by SEQ ID NO: 16215-TEG-16394 or 16216-TEG-16395 (TEG linker) or SEQ ID NO: 16217-HEG-16396 or 16218-HEG-16397 (HEG linker).

As such, in another preferred embodiment, a compound of the invention is preferably for skipping exon 51 of the pre-mRNA of dystrophin, and comprises or consists of a first antisense oligonucleotide represented by a nucleotide sequence comprising or consisting of SEQ ID NO: 774, 775, 776, 777 or 778, more preferably SEQ ID NO: 774, 775, 776 or 777, even more preferably SEQ ID NO: 774 or 775, most preferably SEQ ID NO: 774, and a second antisense oligonucleotide represented by a nucleotide sequence comprising or consisting of SEQ ID NO: 958, 959, 960 or 961, more preferably SEQ ID NO: 958 or 959, even more preferably SEQ ID NO: 958, wherein said first and second antisense oligonucleotide are linked to each other by a linking moiety (as described in the section entitled "Linking moiety"), preferably said linking moiety is tri-ethylene glycol (TEG) or hexa-ethylene glycol (HEG).

Said SEQ ID NO: 774 is represented by the sequence GGTAAGTTCTGTCCAAGC, said SEQ ID NO: 775 is represented by the sequence GTAAGTTCTGTCCAAGCC, said SEQ ID NO: 776 is represented by the sequence AGTCGGTAAGTTCTGTCC, said SEQ ID NO: 777 is represented by the sequence CTGTCCAAGCCGGTTGA, said SEQ ID NO: 778 is represented by the sequence TAAGTTCTGTCCAAG, said SEQ ID NO: 958 is represented by the sequence TCAAGGAAGATGGCATTTCT, said SEQ ID NO: 959 is represented by the sequence TCAAGGAAGATGGCATTTCTAG, said SEQ ID NO: 960 is represented by the sequence TCAAGGAAGATGGCAT and said SEQ ID NO: 961 is represented by the sequence GAAGATGGCATTTCT, wherein T is 5-methyluracil.

Throughout this application, unless otherwise specified, T and U* both mean a thymine or a 5-methyluracil base. It is clear to the skilled person that a thymine and a 5-methyluracil base are identical.

In the context of the invention, the positions of said first and second antisense oligonucleotides within the compound of the invention are interchangeable. As such, a preferred compound of the invention can be represented by:

i) SEQ ID NO: 16255-TEG-SEQ ID NO: 16434 (GGTAAGTTCTGTCCAAGCn TCAAGGAAGATGGCATTTCT) or SEQ ID NO: 16256-TEG-SEQ ID NO: 16435 (TCAAGGAAGATGGCATTTCTnGGTAAGTTCTGTCCAAGC), wherein the linking moiety, represented by n, is a TEG linker, or ii) SEQ ID NO: 16257-HEG-SEQ ID NO: 16436 (GGTAAGTTCTGTCCAAGCnTCAAGGAAGATGGCATTTCT) or SEQ ID NO: 16258-HEG-SEQ ID NO: 16437 (TCAAGGAAGATGGCATTTCTnGGTAAGTTCTGTCCAAGC), wherein the linking moiety, represented by n, is a HEG linker, or iii) SEQ ID NO: 16259-TEG-SEQ ID NO: 16438 (GGTAAGTTCTGTCCAAGCnTCAAGGAAGATGGCATTTCTAG) or SEQ ID NO: 16260-TEG-SEQ ID NO: 16439 (TCAAGGAAGATGGCATTTCTAGnGGTAAGTTCTGTCCAAGC), wherein the linking moiety, represented by n, is a TEG linker, or iv) SEQ ID NO: 16261-HEG-SEQ ID NO: 16440 (GGTAAGTTCTGTCCAAGCnTCAAGGAAGATGGCATTTCTAG) or SEQ ID NO: 16262-HEG-SEQ ID NO: 16441 (TCAAGGAAGATGGCATTTCTAGnGGTAAGTTCTGTCCAAGC), wherein the linking moiety, represented by n, is a HEG linker, or v) SEQ ID NO: 16263-TEG-SEQ ID NO: 16442 (GTAAGTTCTGTCCAAGCCnTCAAGGAAGATGGCATTTCT) or SEQ ID NO: 16264-TEG-SEQ ID NO: 16443 (TCAAGGAAGATGGCAT- TTCTnGTAAGTTCTGTCCAAGCC), wherein the linking moiety, represented by n, is a TEG linker, or vi) SEQ ID NO: 16265-HEG-SEQ ID NO: 16444 (GTAAGTTCTGTCCAAGCCnTCAAGGAA-GATGGCATTTCT) or SEQ ID NO: 16266-HEG-SEQ ID NO: 16445 (TCAAGGAAGATGGCAT-TTCTnGTAAGTTCTGTCCAAGCC), wherein the linking moiety, represented by n, is a HEG linker, or vii) SEQ ID NO: 16267-TEG-SEQ ID NO: 16446 (GTAAGTTCTGTCCAAGCCnTCAAGGAA-GATGGCATTTCTAG) or SEQ ID NO: 16268-TEG-SEQ ID NO: 16447 (TCAAGGAAGATGGCAT-TTCTAGnGTAAGTTCTGTCCAAGCC), wherein the linking moiety, represented by n, is a TEG linker, or viii) SEQ ID NO: 16269-HEG-SEQ ID NO: 16448 (GTAAGTTCTGTCCAAGCCnTCAAGGAA-GATGGCATTTCTAG) or SEQ ID NO: 16270-HEG-SEQ ID NO: 16449 (TCAAGGAAGATGGCAT-TTCTAGnGTAAGTTCTGTCCAAGCC), wherein the linking moiety, represented by n, is a HEG linker, or ix) SEQ ID NO: 16271-TEG-SEQ ID NO: 16450 (AGTCGGTAAGTTCTGTCCnTCAAGGAA-GATGGCATTTCT) or SEQ ID NO: 16272-TEG-SEQ ID NO: 16451 (TCAAGGAAGATGGCATTTCT-nAGTCGGTAAGTTCTGTCC), wherein the linking moiety, represented by n, is a TEG linker, or x) SEQ ID NO: 16273-HEG-SEQ ID NO: 16452 (AGTCGGTAAGTTCTGTCCnTCAAGGAA-GATGGCATTTCT) or SEQ ID NO: 16274-HEG-SEQ ID NO: 16453 (TCAAGGAAGATGGCATTTCT-nAGTCGGTAAGTTCTGTCC), wherein the linking moiety, represented by n, is a HEG linker, or xi) SEQ ID NO: 16275-TEG-SEQ ID NO: 16454 (AGTCGGTAAGTTCTGTCCnTCAAGGAA-GATGGCATTTCTAG) or SEQ ID NO: 16276-TEG-SEQ ID NO: 16455 (TCAAGGAAGATGGCAT-TTCTAGnAGTCGGTAAGTTCTGTCC), wherein the linking moiety, represented by n, is a TEG linker, or xii) SEQ ID NO: 16277-HEG-SEQ ID NO: 16456 (AGTCGGTAAGTTCTGTCCnTCAAGGAA-GATGGCATTTCTAG) or SEQ ID NO: 16278-HEG-SEQ ID NO: 16457 (TCAAGGAAGATGGCAT-TTCTAGnAGTCGGTAAGTTCTGTCC), wherein the linking moiety, represented by n, is a HEG linker, or xiii) SEQ ID NO: 16279-TEG-SEQ ID NO: 16458 (CTGTCCAAGCCCGGTTGAnTCAAGGAA-GATGGCATTTCT) or SEQ ID NO: 16280-TEG-SEQ ID NO: 16459 (TCAAGGAAGATGGCAT-TTCTnCTGTCCAAGCCCGGTTGA), wherein the linking moiety, represented by n, is a TEG linker, or xiv) SEQ ID NO: 16281-HEG-SEQ ID NO: 16460 (CTGTCCAAGCCCGGTTGAnTCAAGGAA-GATGGCATTTCT) or SEQ ID NO: 16282-HEG-SEQ ID NO: 16461 (TCAAGGAAGATGGCAT-TTCTnCTGTCCAAGCCCGGTTGA), wherein the linking moiety, represented by n, is a HEG linker, or xv) SEQ ID NO: 16283-TEG-SEQ ID NO: 16462 (CTGTCCAAGCCCGGTTGAnTCAAGGAA-GATGGCATTTCTAG) or SEQ ID NO: 16284-TEG-SEQ ID NO: 16463 (TCAAGGAAGATGGCAT-TTCTAGnCTGTCCAAGCCCGGTTGA), wherein the linking moiety, represented by n, is a TEG linker, or xvi) SEQ ID NO: 16285-HEG-SEQ ID NO: 16464 (CTGTCCAAGCCCGGTTGAnTCAAGGAA-GATGGCATTTCTAG) or SEQ ID NO: 16286-HEG-SEQ ID NO: 16465 (TCAAGGAAGATGGCAT-TTCTAGnCTGTCCAAGCCCGGTTGA), wherein the linking moiety, represented by n, is a HEG linker, or xvii) SEQ ID NO: 16287-TEG-SEQ ID NO: 16466 (TAAGTTCTGTCCAAGnTCAAGGAAGATGG-CAT) or SEQ ID NO: 16288-TEG-SEQ ID NO: 16467 (TCAAGGAAGATGGCATnTAAGTTCTGTC-CAAG), wherein the linking moiety, represented by n, is a TEG linker, or xviii) SEQ ID NO: 16289-HEG-SEQ ID NO: 16468 (TAAGTTCTGTCCAAGnTCAAGGAAGATGG-CAT) or SEQ ID NO: 16290-HEG-SEQ ID NO: 16469 (TCAAGGAAGATGGCATnTAAGTTCTGTC-CAAG), wherein the linking moiety, represented by n, is a HEG linker, or xix) SEQ ID NO: 16291-TEG-SEQ ID NO: 16470 (TAAGTTCTGTCCAAGnGAAGATGGCATTTCT) or SEQ ID NO: 16292-TEG-SEQ ID NO: 16471 (GAAGATGGCATTTCTnTAAGTTCTGTCCAAG), wherein the linking moiety, represented by n, is a TEG linker, or xx) SEQ ID NO: 16293-HEG-SEQ ID NO: 16472 (TAAGTTCTGTCCAAGnGAAGATGGCATTTCT) or SEQ ID NO: 16294-HEG-SEQ ID NO: 16473 (GAAGATGGCATTTCTnTAAGTTCTGTCCAAG), wherein the linking moiety, represented by n, is a HEG linker, wherein T is 5-methyluracil.

A more preferred compound of the invention is represented by any one of SEQ ID NO: 16255-TEG-16434, 16256-TEG-16435, 16259-TEG-16438, 16260-TEG-16439, 16263-TEG-16442, 16264-TEG-16443, 16267-TEG-16446, 16268-TEG-16447, 16271-TEG-16450, 16272-TEG-16451, 16275-TEG-16454, 16276-TEG-16455, 16279-TEG-16458, 16280-TEG-16459, 16283-TEG-16462 and 16284-TEG-16463 (TEG linker) or any one of SEQ ID NO: 16257-HEG-16436, 16258-HEG-16437, 16261-HEG-16440, 16262-HEG-16441, 16265-HEG-16444, 16266-HEG-16445, 16269-HEG-16448, 16270-HEG-16449, 16273-HEG-16452, 16274-HEG-16453, 16277-HEG-16456, 16278-HEG-16457, 16281-HEG-16460, 16282-HEG-16461 and 16285-HEG-16464 (HEG linker).

An even more preferred compound of the invention is represented by any one of SEQ ID NO: 16271-TEG-16450, 16272-TEG-16451, 16275-TEG-16454, 16276-TEG-16455, 16279-TEG-16458, 16280-TEG-16459, 16283-TEG-16462 and 16284-TEG-16463 (TEG linker) or any one of SEQ ID NO: 16273-HEG-16452, 16274-HEG-16453, 16277-HEG-16456, 16278-HEG-16457, 16281-HEG-16460, 16282-HEG-16461 and 16285-HEG-16464 (HEG linker).

An even more preferred compound of the invention is represented by any one of SEQ ID NO: 16255-TEG-16434, 16256-TEG-16435, 16259-TEG-16438, 16260-TEG-16439, 16263-TEG-16442, 16264-TEG-16443, 16267-TEG-16446 and 16268-TEG-16447 (TEG linker) or any one of SEQ ID NO: 16257-HEG-16436, 16258-HEG-16437, 16261-HEG-16440, 16262-HEG-16441, 16265-HEG-16444, 16266-HEG-16445, 16269-HEG-16448 and 16270-HEG-16449 (HEG linker).

A most preferred compound of the invention is represented by SEQ ID NO: 16255-TEG-16434 or 16256-TEG-16435 (TEG linker) or SEQ ID NO: 16257-HEG-16436 or 16258-HEG-16437 (HEG linker).

As such, in another preferred embodiment, a compound of the invention is preferably for skipping exon 51 of the pre-mRNA of dystrophin, and comprises or consists of a first antisense oligonucleotide represented by a nucleotide sequence comprising or consisting of SEQ ID NO: 1156, 1157, 1158, 1159 or 1160, more preferably SEQ ID NO: 1156, 1157, 1158 or 1159, even more preferably SEQ ID NO: 1156 or 1157, most preferably SEQ ID NO: 1156, and a second antisense oligonucleotide represented by a nucleotide sequence comprising or consisting of SEQ ID NO: 1339, 1340, 1341 or 1342, more preferably SEQ ID NO: 1339 or 1340, even more preferably SEQ ID NO: 1339, wherein said first and second antisense oligonucleotide are linked to each other by a linking moiety (as described in the section entitled "Linking moiety"), preferably said linking moiety is tri-ethylene glycol (TEG) or hexa-ethylene glycol (HEG).

Said SEQ ID NO: 1156 is represented by the sequence GGTAAGTTC*TGTC*C*AAGC*, said SEQ ID NO: 1157 is represented by the sequence GTAAGTTC*TGTC*C*AAGC*C*, said SEQ ID NO: 1158 is represented by the sequence AGTC*GGTAAGTTC*TGTC*C*, said SEQ ID NO: 1159 is represented by the sequence C*TGTC*C*AAGC*C*C*GGTTGA, said SEQ ID NO: 1160 is represented by the sequence TAAGTTC*TGTC*C*AAG, said SEQ ID NO: 1339 is represented by the sequence TC*AAGGAAGATGGC*ATTTC*T, said SEQ ID NO: 1340 is represented by the sequence TC*AAGGAAGATGGC*ATTTC*TAG, said SEQ ID NO: 1341 is represented by the sequence TC*AAGGAAGATGGC*AT and said SEQ ID NO: 1342 is represented by the sequence GAAGATGGC*ATTTC*T, wherein C* is 5-methylcytosine and T is 5-methyluracil.

In the context of the invention, the positions of said first and second antisense oligonucleotides within the compound of the invention are interchangeable. As such, a preferred compound of the invention can be represented by:

i) SEQ ID NO: 16295-TEG-SEQ ID NO: 16474 (GGTAAGTTC*TGTC*C*AAGC*nTC*AAGGAAGATGGC*ATTTC*T) or SEQ ID NO: 16296-TEG-SEQ ID NO: 16475 (TC*AAGGAAGATGGC*ATTTC*TnGGTAAGTTC*TGTC*C*AAGC*), wherein the linking moiety, represented by n, is a TEG linker, or ii) SEQ ID NO: 16297-HEG-SEQ ID NO: 16476 (GGTAAGTTC*TGTC*C*AAGC*nTC*AAGGAAGATGGC*ATTTC*T) or SEQ ID NO: 16298-HEG-SEQ ID NO: 16477 (TC*AAGGAAGATGGC*ATTTC*TnGGTAAGTTC*TGTC*C*AAGC*), wherein the linking moiety, represented by n, is a HEG linker, or iii) SEQ ID NO: 16299-TEG-SEQ ID NO: 16478 (GGTAAGTTC*TGTC*C*AAGC*nTC*AAGGAAGATGGC*ATTTC*TAG) or SEQ ID NO: 16300-TEG-SEQ ID NO: 16479 (TC*AAGGAAGATGGC*ATTTC*TAGnGGTAAGTC*TGTC*C*AAGC*), wherein the linking moiety, represented by n, is a TEG linker, or iv) SEQ ID NO: 16301-HEG-SEQ ID NO: 16480 (GGTAAGTTC*TGTC*C*AAGC*nTC*AAGGAAGATGGC*ATTTC*TAG) or SEQ ID NO: 16302-HEG-SEQ ID NO: 16481 (TC*AAGGAAGATGGC*ATTTC*TAGnGGTAAGTC*TGTC*C*AAGC*), wherein the linking moiety, represented by n, is a HEG linker, or v) SEQ ID NO: 16303-TEG-SEQ ID NO: 16482 (GTAAGTTC*TGTC*C*AAGC*C*nTC*AAGGAAGATGGC*ATTTC*T) or SEQ ID NO: 16304-TEG-SEQ ID NO: 16483 (TC*AAGGAAGATGGC*ATTTC*TnGTAAGTTC*TGTC*C*AAGC*C*), wherein the linking moiety, represented by n, is a TEG linker, or vi) SEQ ID NO: 16305-HEG-SEQ ID NO: 16484 (GTAAGTTC*TGTC*C*AAGC*C*nTC*AAGGAAGATGGC*ATTTC*T) or SEQ ID NO: 16306-HEG-SEQ ID NO: 16485 (TC*AAGGAAGATGGC*ATTTC*TnGTAAGTTC*TGTC*C*AAGC*C*), wherein the linking moiety, represented by n, is a HEG linker, or vii) SEQ ID NO: 16307-TEG-SEQ ID NO: 16486 (GTAAGTTC*TGTC*C*AAGC*C*nTC*AAGGAAGATGGC*ATTTC*TAG) or SEQ ID NO: 16308-TEG-SEQ ID NO: 16487 (TC*AAGGAAGATGGC*ATTTC*TAGnGTAAGTTC*TGTC*C*AAGC*C*), wherein the linking moiety, represented by n, is a TEG linker, or viii) SEQ ID NO: 16309-HEG-SEQ ID NO: 16488 (GTAAGTTC*TGTC*C*AAGC*C*nTC*AAGGAAGATGGC*ATTTC*TAG) or SEQ ID NO: 16310-HEG-SEQ ID NO: 16489 (TC*AAGGAAGATGGC*ATTTC*TAGnGTAAGTTC*TGTC*C*AAGC*C*), wherein the linking moiety, represented by n, is a HEG linker, or ix) SEQ ID NO: 16311-TEG-SEQ ID NO: 16490 (AGTC*GGTAAGTTC*TGTC*C*nTC*AAGGAAGATGGC*ATTTC*T) or SEQ ID NO: 16312-TEG-SEQ ID NO: 16491 (TC*AAGGAAGATGGC*ATTTC*TnAGTC*GGTAAGTTC*TGTC*C*), wherein the linking moiety, represented by n, is a TEG linker, or x) SEQ ID NO: 16313-HEG-SEQ ID NO: 16492 (AGTC*GGTAAGTTC*TGTC*C*nTC*AAGGAAGATGGC*ATTTC*T) or SEQ ID NO: 16314-HEG-SEQ ID NO: 16493 (TC*AAGGAAGATGGC*ATTTC*TnAGTC*GGTAAGTTC*TGTC*C*), wherein the linking moiety, represented by n, is a HEG linker, or xi) SEQ ID NO: 16315-TEG-SEQ ID NO: 16494 (AGTC*GGTAAGTTC*TGTC*C*nTC*AAGGAAGATGGC*ATTTC*TAG) or SEQ ID NO: 16316-TEG-SEQ ID NO: 16495 (TC*AAGGAAGATGGC*ATTTC*TAGnAGTC*GGTAAGTTC*TGTC*C*), wherein the linking moiety, represented by n, is a TEG linker, or xii) SEQ ID NO: 16317-HEG-SEQ ID NO: 16496 (AGTC*GGTAAGTTC*TGTC*C*nTC*AAGGAAGATGGC*ATTTC*TAG) or SEQ ID NO: 16318-HEG-SEQ ID NO: 16497 (TC*AAGGAAGATGGC*ATTTC*TAGnAGTC*GGTAAGTTC*TGTC*C*), wherein the linking moiety, represented by n, is a HEG linker, or xiii) SEQ ID NO: 16319-TEG-SEQ ID NO: 16498 (C*TGTC*C*AAGC*C*C*GGTTGAnTC*AAGGAAGATGGC*ATTTC*T) or SEQ ID NO: 16320-TEG-SEQ ID NO: 16499 (TC*AAGGAAGATGGC*ATTTC*TnC*TGTC*C*AAGC*C*C*GGTTGA), wherein the linking moiety, represented by n, is a TEG linker, or xiv) SEQ ID NO: 16321-HEG-SEQ ID NO: 16500 (C*TGTC*C*AAGC*C*C*GGTTGAnTC*AAGGAAGATGGC*ATTTC*T) or SEQ ID NO: 16322-HEG-SEQ ID NO: 16501 (TC*AAGGAAGATGGC*ATTTC*TnC*TGTC*C*AAGC*C*C*GGTTGA), wherein the linking moiety, represented by n, is a HEG linker, or xv) SEQ ID NO: 16323-TEG-SEQ ID NO: 16502 (C*TGTC*C*AAGC*C*C*GGTTGAnTC*AAGGA AGATGGC*ATTTC*TAG) or SEQ ID NO: 16324-TEG-SEQ ID NO: 16503 (TC*AAGGAAGATGGC*ATTTC*TAGnC*TGTC* C*AAGC*C*C*GGTTGA), wherein the linking moiety, represented by n, is a TEG linker, or xvi) SEQ ID NO: 16325-HEG-SEQ ID NO: 16504 (C*TGTC*C*AAGC*C*C*GGTTGAnTC*AAGGA AGATGGC*ATTTC*TAG) or SEQ ID NO: 16326-HEG-SEQ ID NO: 16505 (TC*AAGGAAGATGGC*ATTTC*TAGnC*TGTC* C*AAGC*C*C*GGTTGA), wherein the linking moiety, represented by n, is a HEG linker, or xvii) SEQ ID NO: 16327-TEG-SEQ ID NO: 16506 (TAAGTTC*TGTC*C*AAGnTC*AAGGAAGATGG C*AT) or SEQ ID NO: 16328-TEG-SEQ ID NO: 16507 (TC*AAGGAAGATGGC*ATnTAAGTTC*TGTC*C* AAG), wherein the linking moiety, represented by n, is a TEG linker, or xviii) SEQ ID NO: 16329-HEG-SEQ ID NO: 16508 (TAAGTTC*TGTC*C*AAGnTC*AAGGAAGATGG C*AT) or SEQ ID NO: 16330-HEG-SEQ ID NO: 16509 (TC*AAGGAAGATGGC*ATnTAAGTTC*TGTC*C* AAG), wherein the linking moiety, represented by n, is a HEG linker, or xix) SEQ ID NO: 16331-TEG-SEQ ID NO: 16510 (TAAGTTC*TGTC*C*AAGnGAAGATGGC*ATTT C*T) or SEQ ID NO: 16332-TEG-SEQ ID NO: 16511 (GAAGATGGC*ATTTC*TnTAAGTTC*TGTC*C*A AG), wherein the linking moiety, represented by n, is a TEG linker, or xx) SEQ ID NO: 16333-HEG-SEQ ID NO: 16512 (TAAGTTC*TGTC*C*AAGnGAAGATGGC*ATTT C*T) or SEQ ID NO: 16334-HEG-SEQ ID NO: 16513 (GAAGATGGC*ATTTC*TnTAAGTTC*TGTC*C*A AG), wherein the linking moiety, represented by n, is a HEG linker, wherein C* is 5-methylcytosine and T is 5-methyluracil.

A more preferred compound of the invention is represented by any one of SEQ ID NO: 16295-TEG-16474, 16296-TEG-16475, 16299-TEG-16478, 16300-TEG-16479, 16303-TEG-16482, 16304-TEG-16483, 16307-TEG-16486, 16308-TEG-16487, 16311-TEG-16490, 16312-TEG-16491, 16315-TEG-16494, 16316-TEG-16495, 16319-TEG-16498, 16320-TEG-16499, 16323-TEG-16502 and 16324-TEG-16503 (TEG linker) or any one of SEQ ID NO: 16297-HEG-16476, 16298-HEG-16477, 16301-HEG-16480, 16302-HEG-16481, 16305-HEG-16484, 16306-HEG-16485, 16309-HEG-16488, 16310-HEG-16489, 16313-HEG-16492, 16314-HEG-16493, 16317-HEG-16496, 16318-HEG-16497, 16321-HEG-16500, 16322-HEG-16501, 16325-HEG-16504 and 16326-HEG-16505 (HEG linker).

An even more preferred compound of the invention is represented by any one of SEQ ID NO: 16311-TEG-16490, 16312-TEG-16491, 16315-TEG-16494, 16316-TEG-16495, 16319-TEG-16498, 16320-TEG-16499, 16323-TEG-16502 and 16324-TEG-16503 (TEG linker) or any one of SEQ ID NO: 16313-HEG-16492, 16314-HEG-16493, 16317-HEG-16496, 16318-HEG-16497, 16321-HEG-16500, 16322-HEG-16501, 16325-HEG-16504 and 16326-HEG-16505 (HEG linker).

An even more preferred compound of the invention is represented by any one of SEQ ID NO: 16295-TEG-16474, 16296-TEG-16475, 16299-TEG-16478, 16300-TEG-16479, 16303-TEG-16482, 16304-TEG-16483, 16307-TEG-16486 and 16308-TEG-16487 (TEG linker) or any one of SEQ ID NO: 16297-HEG-16476, 16298-HEG-16477, 16301-HEG-16480, 16302-HEG-16481, 16305-HEG-16484, 16306-HEG-16485, 16309-HEG-16488 and 16310-HEG-16489 (HEG linker).

A most preferred compound of the invention is represented by SEQ ID NO: 16295-TEG-16474 or 16296-TEG-16475 (TEG linker) or SEQ ID NO: 16297-HEG-16476 or 16298-HEG-16477 (HEG linker).

In an embodiment, said compound of the invention comprises or consists of a first and a second antisense oligonucleotide linked to each other by a linking moiety, wherein said first and/or said second antisense oligonucleotide preferably comprises a scaffold modification that increases binding affinity to target strands, increases melting temperature of the resulting duplex of said first and/or second oligonucleotide with its target, and/or decreases immunostimulatory effects, and/or increases biostability, and/or improves biodistribution and/or intra-tissue distribution, and/or cellular uptake and trafficking. Encompassed by the invention are those scaffold modifications that result in a bicyclic nucleic acid (BNA) monomer. A bicyclic scaffold is generally a pentose-derived scaffold that has been chemically altered to conformationally restrict the scaffold, leading to the improved effects above. Examples of bicyclic scaffolds are scaffolds where a first cycle such as a pentose cycle forms a spirane with a further cyclic moiety so that both cycles share only one atom, scaffolds where a first cycle such as a pentose cycle is fused to a further cyclic moiety so that both cycles share two adjacent atoms, and scaffolds where a first cycle such as a pentose cycle forms a bridged compound through a moiety that is linked to the first cyclic moiety at two non-adjacent atoms. Such non-adjacent atoms are referred to as bridgehead atoms. Bridged compounds comprise multiple cycles, each of which overlap over at least three atoms. A compound with two cycles wherein those cycles overlap over only two atoms is a fused compound instead. In some bridged compounds, the smallest link between two bridgehead atoms is referred to as the bridging moiety, or as the bridge moiety. In other bridged compounds, when one cycle is a characteristic cycle such as the pentose cycle of a nucleotide, the moiety that is not constitutive to that characteristic cycle is referred to as the bridging moiety. It follows that the nomenclature of bridged bicyclic compounds is context-dependent.

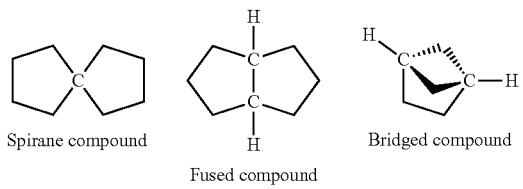

Spirane compound    Fused compound    Bridged compound

Bicyclic compounds can comprise additional cycles. A bicyclic compound is at least bicyclic, and said two cycles constitute a spirane, a fused system, or a bridged system, or a combination thereof. The invention does not encompass Not encompassed are scaffold modifications where two independent cycles are linked via a non-cyclic linker, so as to not form a spirane, fused compound, or bridged compound. Preferred bicyclic compounds are fused and bridged compounds. In more preferred embodiments, a bicyclic nucleic acid monomer (BNA) is a bridged nucleic acid monomer. As described herein, both a "bridged" or a "bicyclic" nucleic acid monomer relates to a nucleotide with a modified scaffold that enhances the melting temperature of an oligonucleotide against an RNA target as compared to a non-BNA nucleotide-containing control oligonucleotide.

In a preferred embodiment is provided a compound of the invention, wherein each occurrence of said bicyclic nucleic acid (BNA) scaffold modification in said first and/or second antisense oligonucleotide results in a monomer that is independently chosen from the group consisting of a conformationally restricted nucleotide (CRN) monomer, a locked nucleic acid (LNA) monomer, a xylo-LNA monomer, an α-LNA monomer, an α-L-LNA monomer, a β-D-LNA monomer, a 2'-amino-LNA monomer, a 2'-(alkylamino)-LNA monomer, a 2'-(acylamino)-LNA monomer, a 2'-N-substituted-2'-amino-LNA monomer, a 2'-thio-LNA monomer, a (2'-O,4'-C) constrained ethyl (cEt) BNA monomer, a (2'-0,4'-C) constrained methoxyethyl (cMOE) BNA monomer, a 2',4'-BNA$^{NC}$(N—H) monomer, a 2',4'-BNA$^{NC}$(N-Me) monomer, a 2',4'-BNA$^{NC}$(N-Bn) monomer, an ethylene-bridged nucleic acid (ENA) monomer, a carba LNA (cLNA) monomer, a 3,4-dihydro-2H-pyran nucleic acid (DpNA) monomer, a 2'-C-bridged bicyclic nucleotide (CBBN) monomer, a heterocyclic-bridged BNA monomer, an amido-bridged BNA monomer, an urea-bridged BNA monomer, a sulfonamide-bridged BNA monomer, a bicyclic carbocyclic nucleotide monomer, a TriNA monomer, an α-L-TriNA monomer, a bicyclo DNA (bcDNA) monomer, an F-bcDNA monomer, a tricyclo DNA (tcDNA) monomer, an F-tcDNA monomer, an oxetane nucleotide monomer, a locked PMO monomer derived from 2'-amino-LNA, and derivatives thereof. It is also encompassed by the invention to introduce more than one distinct scaffold BNA modification in said oligonucleotide. More preferably, each occurrence of said BNA scaffold modification results in a monomer that is independently chosen from the group consisting of a conformationally restrained nucleotide (CRN) monomer, a locked nucleic acid (LNA) monomer, a xylo-LNA monomer, an α-L-LNA monomer, a β-D-LNA monomer, a 2'-amino-LNA monomer, a 2'-(alkylamino)-LNA monomer, a 2'-(acylamino)-LNA monomer, a 2'-N-substituted-2'-amino-LNA monomer, a (2'-0,4'-C) constrained ethyl (cEt) LNA monomer, a (2'-0,4'-C) constrained methoxyethyl (cMOE) BNA monomer, a 2',4'-BNA$^{NC}$(N—H) monomer, a 2',4'-BNA$^{NC}$(N-Me) monomer, an ethylene-bridged nucleic acid (ENA) monomer, a 2'-C-bridged bicyclic nucleotide (CBBN) monomer, and derivatives thereof. Even more preferably, each occurrence of said BNA scaffold modification results in a locked nucleic acid (LNA) monomer.

Structural examples of monomers comprising these BNA scaffold modifications are shown below, where B is a base as defined earlier herein, X is a variable, $X_2$ is a hydroxyl moiety or another 2'-substitution as defined earlier herein, and L is a backbone linkage as described earlier herein. In the literature, the naming of such modifications is often arbitrary and does not follow a uniform convention—in this application, the names as provided below are intended to refer to the structures provided below. For comparison, the cyclic scaffold of a conventional RNA monomer is shown first. In the structures shown below, monomers are typically depicted as 3'-terminal monomers. When chirality is not indicated, each enantiomer is individually referenced. A monomer resulting from the occurrence of a BNA scaffold modification in said first and/or second antisense oligonucleotide of a compound of the invention is not limited to this kind of monomers which are provided for illustrative purposes. Heteroatoms comprised in a cyclic moiety can be substituted by other heteroatoms.

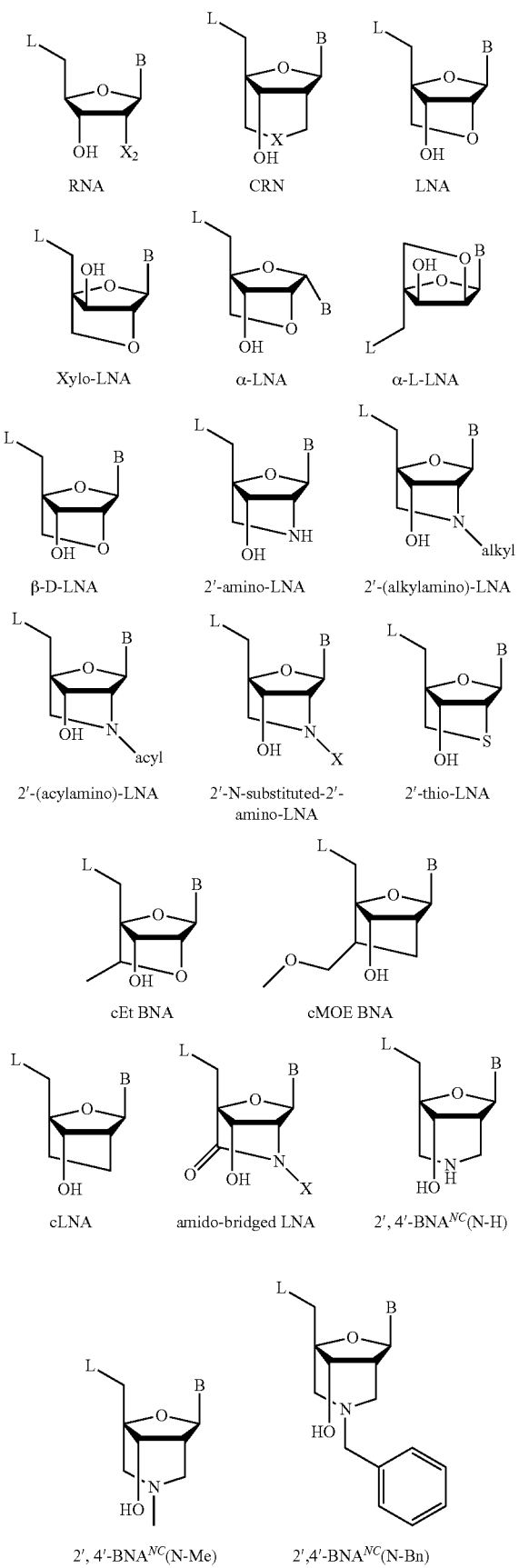

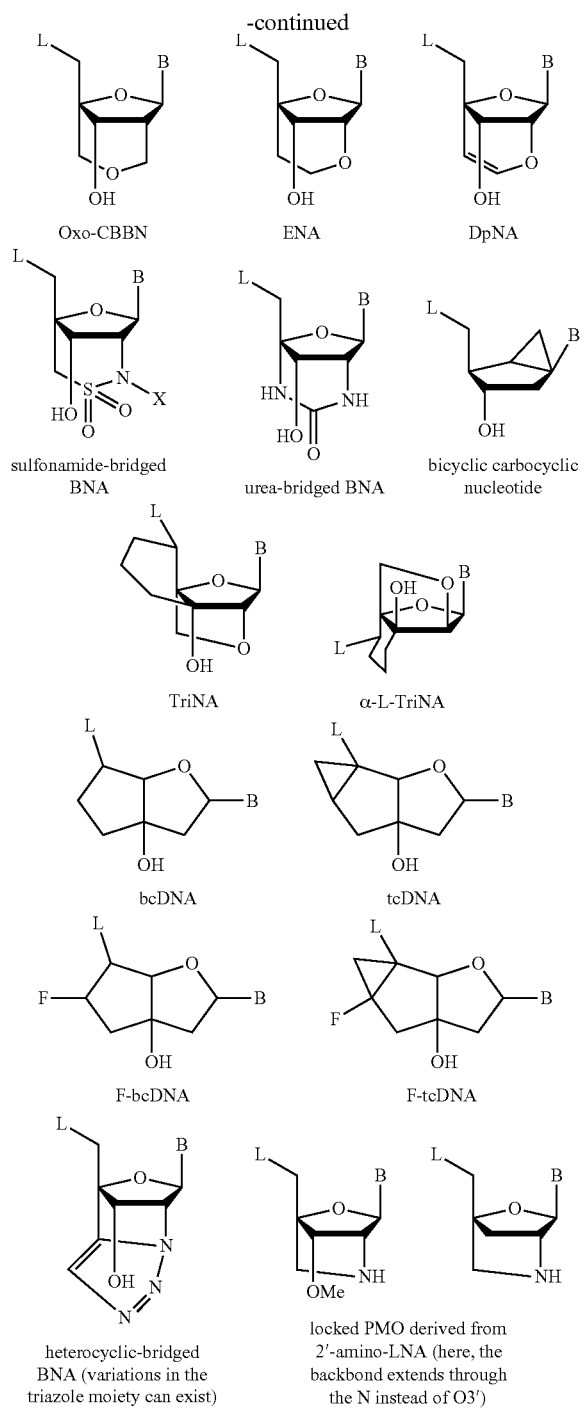

The following is a non-exhaustive overview of literature references for BNA scaffold modifications shown above: cEt (2'-0,4'-C constrained ethyl) LNA (doi: 10.1021/ja710342q), cMOE (2'-0,4'-C constrained methoxyethyl) LNA (Seth et al., J. Org. Chem. 2010, 75, 1569-1581), 2',4'-BNA$^{NC}$(N—H), 2',4'-BNA$^{NC}$(N-Me), ethylene-bridged nucleic acid (ENA) (doi: 10.1093/nass/1.1.241), carba LNA (cLNA) (doi: 10.1021/jo100170g), DpNA (Osawa et al., J. Org. Chem., 2015, 80 (21), pp 10474-10481), 2'-C-bridged bicyclic nucleotide (CBBN, as in e.g. WO 2014/145356 (MiRagen Therapeutics)), heterocyclic-bridged LNA (as in e.g. WO 2014/126229 (Mitsuoka Y et al.)), amido-bridged LNA (as in e.g. Yamamoto et al. Org. Biomol. Chem. 2015, 13, 3757), urea-bridged LNA (as in e.g. Nishida et al. Chem. Commun. 2010, 46, 5283), sulfonamide-bridged LNA (as in e.g. WO 2014/112463 (Obika S et al.)), bicyclic carbocyclic nucleosides (as in e.g. WO 2015/142910 (Ions Pharmaceuticals)), TriNA (Hanessian et al., J. Org. Chem., 2013, 78 (18), pp 9064-9075), α-L-TriNA, bicyclo DNA (bcDNA) (Bolli et al., Chem Biol. 1996 March; 3(3):197-206), F-bcDNA (DOI: 10.1021/jo402690j), tricyclo DNA (tcDNA) (Murray et al., Nucl. Acids Res., 2012, Vol. 40, No. 13 6135-6143), F-tcDNA (doi: 10.1021/acs.joc.5b00184), an oxetane nucleotide monomer (Nucleic Acids Res. 2004, 32, 5791-5799). For those not mentioned above, reference is made to WO 2011/097641 (ISIS/Ionis Pharmaceuticals) and WO2016/017422 (Osaka University), which are incorporated in their entirety by reference.

Preferably, a first and/or second oligonucleotide of the compound of the invention comprises RNA monomers, as RNA/RNA duplexes are very stable. It is preferred that an RNA oligonucleotide comprises a modification providing the RNA with an additional property, for instance resistance to endonucleases, exonucleases, and RNaseH, additional hybridisation strength, increased stability (for instance in a bodily fluid), increased or decreased flexibility, increased activity, reduced toxicity, increased intracellular transport, increased cellular uptake, tissue-specificity, etc. In addition, the mRNA complexed with said oligonucleotide is preferably not susceptible to RNaseH cleavage. Preferred modifications have been identified above.

Accordingly, a compound of the invention comprises or consists of a first and a second antisense oligonucleotide, wherein said first and/or said second antisense oligonucleotide comprises a 2'-O-methyl phosphorothioate RNA monomer or consists of 2'-O-methyl phosphorothioate RNA, preferably said first and/or second AON further comprises a BNA, optionally a 5-methylpyrimidine base (i.e. 5-methylcytosine and/or 5-methyluracil) is present. Most preferably, said first and/or second oligonucleotide consists of 2'-O-methyl RNA monomers connected through a phosphorothioate or phosphate backbone and all of its cytosines and/or all of its uracils, independently, have been substituted by 5-methylcytosine and/or 5-methyluracil, respectively, and at least one 2'-O-methyl scaffold has been replaced by a BNA, preferably 1, 2, 3, 4, 5, 6, 7, 8 or 9 monomers are replaced by a BNA, more preferably 1, 2, 3, 4, 5, 6, 7, 8 or 9 monomers are replaced by a bridged nucleic acid scaffold modification, even more preferably 1, 2, 3, 4, 5, 6, 7, 8 or 9 monomers are replaced by a LNA. Preferably said first and second antisense oligonucleotides of the compound of the invention are distinct, more preferably the nucleotide sequence of said first and second antisense oligonucleotide are represented by a distinct SEQ ID NO.

In preferred embodiments of this aspect of the invention (i.e. chemical modifications of the first and/or second antisense oligonucleotide of the compound) is provided a compound of the invention, wherein the first and/or second oligonucleotide of said compound comprises or consists of 1, 2, 3, 4, 5, 6, 7, 8 or 9 monomers that comprise a bicyclic nucleic acid (BNA) scaffold modification, preferably a bridged nucleic acid scaffold modification, more preferably a LNA modification, and preferably wherein said first and/or second oligonucleotide comprises or consists of 2'-O-substituted RNA monomers linked by phosphorothioate backbone linkages and/or wherein all cytosine bases are 5-methylcytosine and/or wherein all uracil bases are 5-methyluracil bases in said first and/or second oligonucleotide as described earlier herein.

In these embodiments, it is preferred that at least one BNA scaffold modification is comprised in a terminal monomer of said first and/or second oligonucleotide of the compound of the invention, preferably in the 5'-terminal monomer. It is most preferred that both terminal monomers comprise a BNA scaffold. As such, a more preferred embodiment of this aspect provides the first and/or second oligonucleotide of the compound of the invention wherein at least one bicyclic nucleic acid (BNA) scaffold modification is comprised in a terminal monomer of said first and/or second oligonucleotide, preferably in the 5'-terminal monomer of said first and/or second oligonucleotide, more preferably in both terminal monomers of said first and/or second oligonucleotide. Other preferred embodiments entail that a terminal monomer and its neighbouring monomer each comprise a BNA scaffold. In such a case, the first two monomers and/or the last two monomers of said first and/or second oligonucleotide of the compound of the invention each comprise a BNA scaffold. This can be combined in any way, so that for example the first and the last two monomers, or the first two and the last monomer all comprise a BNA scaffold. When a first and/or second oligonucleotide of a compound of the invention comprises a terminal monomer comprising a BNA scaffold, additional monomers with a BNA scaffold are preferably either at the other terminus, or adjacent to terminal monomers with a BNA scaffold.

A preferred embodiment of this aspect of the invention (i.e. chemical modifications of the first and/or second antisense oligonucleotide of the compound) provides a compound of the invention wherein the first and/or second oligonucleotide of said compound, comprises or consists of BNA modifications as selected from the set consisting of:
  a single BNA scaffold modification in the monomer at the 5'-terminus,
  a single BNA scaffold modification in the monomer at the 3'-terminus,
  two BNA scaffold modifications where one is in the monomer at the 5'-terminus and the other is in the monomer at the 3'-terminus,
  two BNA scaffold modifications, one in each of the two monomers that are closest to the 5'-terminus,
  two BNA scaffold modifications, one in each of the two monomers that are closest to the 3'-terminus,
  four BNA scaffold modifications, one in each of the two monomers that are closest to the 5'-terminus and one in each of the two monomers that are closest to the 3'-terminus;
optionally 1, 2, 3, 4 or 5 additional BNA scaffold modifications are present, and preferably wherein said first and/or second oligonucleotide of the compound comprises or consists of 2'-O-substituted RNA monomers linked by phosphorothioate backbone linkages and/or wherein all cytosine bases are 5-methylcytosine and/or wherein all uracil bases are 5-methyluracil bases in said first and/or second oligonucleotide as described earlier herein.

When a first oligonucleotide and/or a second oligonucleotide of the compound of the invention comprises or consists of a sequence represented by any one of SEQ ID NOs: 14 to 197 (first oligonucleotide) or any one of SEQ ID NO: 198 to 398 (second oligonucleotide), preferably the 5'-terminal monomer of said first and/or second oligonucleotide comprises a BNA scaffold modification and optionally 1, 2, 3, 4 or 5 additional monomers comprise a BNA scaffold modification, more preferably only the 5'-terminal monomer of said first and/or second oligonucleotide comprises a BNA scaffold modification, and preferably wherein said first and/or second oligonucleotide comprises or consists of 2'-O-substituted RNA monomers linked by phosphorothioate backbone linkages and/or wherein all cytosine bases are 5-methylcytosine and/or wherein all uracil bases are 5-methyluracil bases in said first and/or second oligonucleotide as defined earlier herein. As such, preferred variants of said first and/or second oligonucleotide of the compound of the invention comprise or consist of a sequence represented by any one of SEQ ID NO: 14 to 197 (first oligonucleotide) or SEQ ID NO: 198 to 398 (second oligonucleotide), or a fragment thereof as earlier defined herein, are represented by any one of SEQ ID NO: 1529 to 1712, preferably SEQ ID NO: 1529, 1530, 1531, 1532 or 1533, more preferably SEQ ID NO: 1529, 1530, 1531 or 1532, even more preferably SEQ ID NO: 1529 or 1530, most preferably SEQ ID NO: 1529 (first oligonucleotide); or any one of SEQ ID NO: 1713 to 1913, preferably SEQ ID NO: 1713, 1714, 1715 or 1716, more preferably SEQ ID NO: 1713 or 1714, even more preferably SEQ ID NO: 1713 (second oligonucleotide). More preferred variants are those wherein:
  all cytosine bases are 5-methylcytosine as represented by any one of SEQ ID NO: 3839 to 4021, preferably SEQ ID NO: 3839, 3840, 3841, 3842 or 3843, more preferably SEQ ID NO: 3839, 3840, 3841 or 3842, even more preferably SEQ ID NO: 3839 or 3840, most preferably SEQ ID NO: 3839 (first oligonucleotide) or any one of SEQ ID NO: 4022 to 4213, preferably SEQ ID NO: 4022, 4023 4024 or 4025, more preferably SEQ ID NO: 4022 or 4023, even more preferably SEQ ID NO: 4022 (second oligonucleotide), or wherein
  all uracil bases are 5-methyluracil as represented by any one of SEQ ID NO: 6089 to 6272, preferably SEQ ID NO: 6089, 6090, 6091, 6092 or 6093, more preferably SEQ ID NO: 6089, 6090, 6091 or 6092, even more preferably SEQ ID NO: 6089 or 6090, most preferably SEQ ID NO: 6089 (first oligonucleotide) or any one of SEQ ID NO: 6273 to 6470, preferably SEQ ID NO: 6273, 6274, 6275 or 6276, more preferably SEQ ID NO: 6273 or 6274, even more preferably SEQ ID NO: 6273 (second oligonucleotide), or wherein
  all cytosine bases are 5-methylcytosine and all uracil bases are 5-methyluracil as represented by any one of SEQ ID NO: 8381 to 8563, preferably SEQ ID NO: 8381, 8382, 8383, 8384 or 8385, more preferably SEQ ID NO: 8381, 8382, 8383 or 8384, even more preferably SEQ ID NO: 8381 or 8382, most preferably SEQ ID NO: 8381 (first oligonucleotide) or any one of SEQ ID NO: 8564 to 8753, preferably SEQ ID NO: 8564, 8565, 8566 or 8567, more preferably SEQ ID NO: 8564 or 8565, even more preferably SEQ ID NO: 8564 (second oligonucleotide).

When a first oligonucleotide and/or a second oligonucleotide of the compound of the invention comprises or consists of a sequence represented by any one of SEQ ID NOs: 14 to 197 (first oligonucleotide) or any one of SEQ ID NO: 198 to 398 (second oligonucleotide), preferably the 3'-terminal monomer of said first and/or second oligonucleotide comprises a BNA scaffold modification and optionally 1, 2, 3, 4 or 5 additional monomers comprise a BNA scaffold modification, more preferably only the 3'-terminal monomer of said first and/or second oligonucleotide comprises a BNA scaffold modification, and preferably wherein said first and/or second oligonucleotide comprises or consists of 2'-O-substituted RNA monomers linked by phosphorothioate backbone linkages and/or wherein all cytosine bases are 5-methylcytosine and/or wherein all uracil bases are 5-methyluracil bases in said first and/or second oligonucleotide as defined earlier herein. As such, preferred variants of said first and/or second oligonucleotide of the compound comprise or consist of a sequence represented by any one of SEQ ID NO: 14 to 197 (first oligonucleotide) or any one of SEQ ID NO: 198 to 398 (second oligonucleotide), or a fragment thereof as earlier defined herein, are represented by any one of SEQ ID NO: 1914 to 2097, preferably SEQ ID NO: 1914, 1915, 1916, 1917 or 1918, more preferably SEQ ID NO: 1914, 1915, 1916 or 1917, even more preferably SEQ ID NO: 1914 or 1915, most preferably SEQ ID NO: 1914 (first oligonucleotide); or any one of SEQ ID NO: 2098 to 2298, preferably SEQ ID NO: 2098, 2099, 2100 or 2101, more preferably SEQ ID NO: 2098 or 2099, even more preferably SEQ ID NO: 2098 (second oligonucleotide). More preferred variants are those wherein:

all cytosine bases are 5-methylcytosine as represented by any one of SEQ ID NO: 4214 to 4396, preferably SEQ ID NO: 4214, 4215, 4216, 4217 or 4218, more preferably SEQ ID NO: 4214, 4215, 4216 or 4217, even more preferably SEQ ID NO: 4214 or 4215, most preferably SEQ ID NO: 4214 (first oligonucleotide) or any one of SEQ ID NO:4397 to 4588, preferably SEQ ID NO: 4397, 4398, 4399 or 4400, more preferably SEQ ID NO: 4397 or 4398, even more preferably SEQ ID NO: 4397 (second oligonucleotide), or wherein all uracil bases are 5-methyluracil as represented by any one of SEQ ID NO: 6471 to 6654, preferably SEQ ID NO: 6471, 6472, 6473, 6474 or 6475, more preferably SEQ ID NO: 6471, 6472, 6473 or 6474, even more preferably SEQ ID NO: 6471 or 6472, most preferably SEQ ID NO: 6471 (first oligonucleotide) or any one of SEQ ID NO: 6655 to 6852, preferably SEQ ID NO: 6655, 6656, 6657 or 6658, more preferably SEQ ID NO: 6655 or 6656, even more preferably SEQ ID NO: 6655 (second oligonucleotide), or wherein all cytosine bases are 5-methylcytosine and all uracil bases are 5-methyluracil as represented by any one of SEQ ID NO: 8754 to 8936, preferably SEQ ID NO: 8754, 8755, 8756, 8757 or 8758, more preferably SEQ ID NO: 8754, 8755, 8756 or 8757, even preferably SEQ ID NO: 8754 or 8755, most preferably SEQ ID NO: 8754 (first oligonucleotide) or any one of SEQ ID NO: 8937 to 9126, preferably SEQ ID NO: 8937, 8938, 8939 or 8940, more preferably SEQ ID NO: 8937 or 8938, even more preferably SEQ ID NO: 8937 (second oligonucleotide).

When a first oligonucleotide and/or a second oligonucleotide of the compound of the invention comprises or consists of a sequence represented by any one of SEQ ID NOs: 14 to 197 (first oligonucleotide) or any one of SEQ ID NO: 198 to 398 (second oligonucleotide), preferably both the 5'-terminal monomer and the 3'-terminal monomer of said first and/or second oligonucleotide comprise a BNA scaffold modification and optionally 1, 2, 3, 4 or 5 additional monomers comprise a BNA scaffold modification, more preferably only both the 5'-terminal monomer and the 3'-terminal monomer of said first and/or second oligonucleotide comprise a BNA scaffold modification, and preferably wherein said first and/or second oligonucleotide comprises or consists of 2'-O-substituted RNA monomers linked by phosphorothioate backbone linkages and/or wherein all cytosine bases are 5-methylcytosine and/or wherein all uracil bases are 5-methyluracil bases in said first and/or second oligonucleotide as defined earlier herein. As such, preferred variants of said first and/or second oligonucleotide of the compound comprise or consist of a sequence represented by any one of SEQ ID NO: 14 to 197 (first oligonucleotide) or any one of SEQ ID NO: 198 to 398 (second oligonucleotide), or a fragment thereof as earlier defined herein, are represented by any one of SEQ ID NO: 2299 to 2482, preferably SEQ ID NO: 2299, 2300, 2301, 2302 or 2303, more preferably SEQ ID NO: 2299, 2300, 2301 or 2302, even more preferably SEQ ID NO: 2299 or 2300, most preferably SEQ ID NO: 2299 (first oligonucleotide); or any one of SEQ ID NO: 2483 to 2683, preferably SEQ ID NO: 2483, 2484, 2485 or 2486, more preferably SEQ ID NO: 2483 or 2484, even more preferably SEQ ID NO: 2483 (second oligonucleotide). More preferred variants are those wherein:

all cytosine bases are 5-methylcytosine as represented by any one of SEQ ID NO: 4589 to 4771, preferably SEQ ID NO: 4589, 4590, 4591, 4592 or 4593, more preferably SEQ ID NO: 4589, 4590, 4591 or 4592, even more preferably SEQ ID NO: 4589 or 4590, most preferably SEQ ID NO: 4589 (first oligonucleotide) or any one of SEQ ID NO: 4772 to 4963, preferably SEQ ID NO: 4772, 4773, 4774 or 4775, more preferably SEQ ID NO: 4772 or 4773, even more preferably SEQ ID NO: 4772 (second oligonucleotide), or wherein all uracil bases are 5-methyluracil as represented by any one of SEQ ID NO: 6853 to 7036, preferably SEQ ID NO: 6853, 6854, 6855, 6856 or 6857, more preferably SEQ ID NO: 6853, 6854, 6855 or 6856, even more preferably SEQ ID NO: 6853 or 6854, most preferably SEQ ID NO: 6853 (first oligonucleotide) or any one of SEQ ID NO: 7037 to 7234, preferably SEQ ID NO: 7037, 7038, 7039 or 7040, more preferably SEQ ID NO: 7037 or 7038, even more preferably SEQ ID NO: 7037 (second oligonucleotide), or wherein all cytosine bases are 5-methylcytosine and all uracil bases are 5-methyluracil as represented by any one of SEQ ID NO: 9127 to 9309, preferably SEQ ID NO: 9127, 9128, 9129, 9130 or 9131, more preferably SEQ ID NO: 9127, 9128, 9129 or 9130, even more preferably SEQ ID NO: 9127 or 9128, most preferably SEQ ID NO: 9127 (first oligonucleotide) or any one of SEQ ID NO: 9310 to 9499, preferably SEQ ID NO: 9310, 9311, 9312 or 9313, more preferably SEQ ID NO: 9310 or 9311, even more preferably SEQ ID NO: 9310 (second oligonucleotide).

When a first oligonucleotide and/or a second oligonucleotide of the compound of the invention comprises or consists of a sequence represented by any one of SEQ ID NOs: 14 to 197 (first oligonucleotide) or any one of SEQ ID NO: 198 to 398 (second oligonucleotide), preferably the two most 5'-terminal monomers of said first and/or second oligonucleotide both comprise a BNA scaffold modification and optionally 1, 2, 3, 4 or 5 additional monomers comprise a BNA scaffold modification, more preferably only the two most 5'-terminal monomers of said first and/or second oligonucleotide both comprise a BNA scaffold modification, and preferably wherein said first and/or second oligonucleotide comprises or consists of 2'-O-substituted RNA monomers linked by phosphorothioate backbone linkages and/or wherein all cytosine bases are 5-methylcytosine and/or wherein all uracil bases are 5-methyluracil bases in said first and/or second oligonucleotide as defined earlier herein. As such, preferred variants of said first and/or second oligonucleotide of the compound comprise or consist of a sequence represented by any one of SEQ ID NO: 14 to 198 (first oligonucleotide) or any one of SEQ ID NO: 198 to 398 (second oligonucleotide), or a fragment thereof as earlier defined herein, are represented by any one of SEQ ID NO: 2684 to 2867, preferably SEQ ID NO: 2684, 2685, 2686, 2687 or 2688, more preferably SEQ ID NO: 2684, 2685, 2686 or 2687, even more preferably SEQ ID NO: 2684 or 2685, most preferably SEQ ID NO: 2684 (first oligonucleotide); or any one of SEQ ID NO: 2868 to 3068, preferably SEQ ID NO: 2868, 2869, 2870 or 2871, more preferably SEQ ID NO: 2868 or 2869, even more preferably SEQ ID NO: 2868 (second oligonucleotide). More preferred variants are those wherein:
  all cytosine bases are 5-methylcytosine as represented by any one of SEQ ID NO: 4964 to 5146, preferably SEQ ID NO: 4964, 4965, 4966, 4967 or 4968, more preferably SEQ ID NO: 4964, 4965, 4966 or 4967, even more preferably SEQ ID NO: 4964 or 4965, most preferably SEQ ID NO: 4964 (first oligonucleotide) or any one of SEQ ID NO: 5147 to 5338, preferably SEQ ID NO: 5147, 5148, 5149 or 5150, more preferably SEQ ID NO: 5147 or 5148, even more preferably SEQ ID NO: 5147 (second oligonucleotide), or wherein
  all uracil bases are 5-methyluracil as represented by any one of SEQ ID NO: 7235 to 7418, preferably SEQ ID NO: 7235, 7236, 7237, 7238 or 7239, more preferably SEQ ID NO: 7235, 7236, 7237 or 7238, even more preferably SEQ ID NO: 7235 or 7236, most preferably SEQ ID NO: 7235 (first oligonucleotide) or any one of SEQ ID NO: 7419 to 7616, preferably SEQ ID NO: 7419, 7420, 7421 or 7422, more preferably SEQ ID NO: 7419 or 7420, even more preferably SEQ ID NO: 7419 (second oligonucleotide), or wherein
  all cytosine bases are 5-methylcytosine and all uracil bases are 5-methyluracil as represented by any one of SEQ ID NO: 9500 to 9682, preferably SEQ ID NO: 9500, 9501, 9502, 9503 or 9504, more preferably SEQ ID NO: 9500, 9501, 9502 or 9503, even more preferably SEQ ID NO: 9500 or 9501, most preferably SEQ ID NO: 9500 (first oligonucleotide) or any one of SEQ ID NO: 9683 to 9872, preferably SEQ ID NO: 9683, 9684, 9685 or 9686, more preferably SEQ ID NO: 9683 or 9684, even more preferably SEQ ID NO: 9683 (second oligonucleotide).

When a first oligonucleotide and/or a second oligonucleotide of the compound of the invention comprises or consists of a sequence represented by any one of SEQ ID NOs: 14 to 197 (first oligonucleotide) or any one of SEQ ID NO: 198 to 398 (second oligonucleotide), preferably the two most 3'-terminal monomers of said first and/or second oligonucleotide both comprise a BNA scaffold modification and optionally 1, 2, 3, 4 or 5 additional monomers comprise a BNA scaffold modification, more preferably only the two most 3'-terminal monomers of said first and/or second oligonucleotide both comprise a BNA scaffold modification, and preferably wherein said first and/or second oligonucleotide comprises or consists of 2'-O-substituted RNA monomers linked by phosphorothioate backbone linkages and/or wherein all cytosine bases are 5-methylcytosine and/or wherein all uracil bases are 5-methyluracil bases in said first and/or second oligonucleotide as defined earlier herein. As such, preferred variants of said first and/or second oligonucleotide of the compound comprise or consist of a sequence represented by any one of SEQ ID NO: 14 to 197 (first oligonucleotide) or any one of SEQ ID NO: 198 to 398 (second oligonucleotide), or a fragment thereof as earlier defined herein, are represented by any one of SEQ ID NO: 3069 to 3252, preferably SEQ ID NO: 3069, 3070, 3071, 3072 or 3073, more preferably SEQ ID NO: 3069, 3070, 3071 or 3072, even more preferably SEQ ID NO: 3069 or 3070, most preferably SEQ ID NO: 3069 (first oligonucleotide); or any one of SEQ ID NO: 3253 to 3453, preferably SEQ ID NO: 3253, 3254, 3255 or 3256, more preferably SEQ ID NO: 3253 or 3254, even more preferably SEQ ID NO: 3253 (second oligonucleotide). More preferred variants are those wherein:
  all cytosine bases are 5-methylcytosine as represented by any one of SEQ ID NO: 5339 to 5521, preferably SEQ ID NO: 5339, 5340, 5341, 5342 or 5343, more preferably SEQ ID NO: 5339, 5340, 5341 or 5342, even more preferably SEQ ID NO: 5339 or 5340, most preferably SEQ ID NO: 5339 (first oligonucleotide) or any one of SEQ ID NO: 5522 to 5713, preferably SEQ ID NO: 5522, 5523, 5524 or 5525, more preferably SEQ ID NO: 5522 or 5523, even more preferably SEQ ID NO: 5522 (second oligonucleotide), or wherein
  all uracil bases are 5-methyluracil as represented by any one of SEQ ID NO: 7617 to 7800, preferably SEQ ID NO: 7617, 7618, 7619, 7620 or 7621, more preferably SEQ ID NO: 7617, 7618, 7619 or 7620, even more preferably SEQ ID NO: 7617 or 7618, most preferably SEQ ID NO: 7617 (first oligonucleotide) or any one of SEQ ID NO:7801 to 7998, preferably SEQ ID NO: 7801, 7802, 7803 or 7804, more preferably SEQ ID NO: 7801 or 7802, even more preferably SEQ ID NO: 7801 (second oligonucleotide), or wherein
  all cytosine bases are 5-methylcytosine and all uracil bases are 5-methyluracil as represented by any one of SEQ ID NO: 9873 to 10055, preferably SEQ ID NO: 9873, 9874, 9875, 9876 or 9877, more preferably SEQ ID NO: 9873, 9874, 9875 or 9876, even more preferably SEQ ID NO: 9873 or 9874, most preferably SEQ ID NO: 9873 (first oligonucleotide) or any one of SEQ ID NO: 10056 to 10245, preferably SEQ ID NO: 10056, 10057, 10058 or 10059, more preferably SEQ ID NO: 10056 or 10057, even more preferably SEQ ID NO: 10056 (second oligonucleotide).

When a first oligonucleotide and/or a second oligonucleotide of the compound of the invention comprises or consists of a sequence represented by any one of SEQ ID NOs: 14 to 197 (first oligonucleotide) or any one of SEQ ID NO: 198 to 398 (second oligonucleotide), preferably the two most 5'-terminal monomers and the two most 3'-terminal monomers of said first and/or second oligonucleotide comprise a BNA scaffold modification and optionally 1, 2, 3, 4 or 5 additional monomers comprise a BNA scaffold modification, more preferably only the two most 5'-terminal and the two most 3'-terminal monomers of said first and/or second oligonucleotide comprise a BNA scaffold modification, and preferably wherein said first and/or second oligonucleotide comprises or consists of 2'-O-substituted RNA monomers linked by phosphorothioate backbone linkages and/or wherein all cytosine bases are 5-methylcytosine and/or wherein all uracil bases are 5-methyluracil bases in said first and/or second oligonucleotide as defined earlier herein. As such, preferred variants of said first and/or second oligonucleotide of the compound comprise or consist of a sequence represented by any one of SEQ ID NO: 14 to 197 (first oligonucleotide) or any one of SEQ ID NO: 198 to 398 (second oligonucleotide), or a fragment thereof as earlier defined herein, are represented by any one of SEQ ID NO: 3454 to 3637, preferably SEQ ID NO: 3454, 3455, 3456, 3457 or 3458, more preferably SEQ ID NO: 3454, 3455, 3456 or 3457, even more preferably SEQ ID NO: 3454 or 3455, most preferably SEQ ID NO: 3454 (first oligonucleotide); or any one of SEQ ID NO: 3638 to 3838, preferably SEQ ID NO: 3638, 3639, 3640 or 3641, more preferably SEQ ID NO: 3638 or 3639, even more preferably SEQ ID NO: 3638 (second oligonucleotide). More preferred variants are those wherein:

all cytosine bases are 5-methylcytosine as represented by any one of SEQ ID NO: 5714 to 5896, preferably SEQ ID NO: 5714, 5715, 5716, 5717 or 5718, more preferably SEQ ID NO: 5714, 5715, 5716 or 5717, even more preferably SEQ ID NO: 5714 or 5715, most preferably SEQ ID NO: 5714 (first oligonucleotide) or any one of SEQ ID NO: 5897 to 6088, preferably SEQ ID NO: 5897, 5898, 5899 or 5900, more preferably SEQ ID NO: 5897 or 5898, even more preferably SEQ ID NO: 5897 (second oligonucleotide), or wherein all uracil bases are 5-methyluracil as represented by any one of SEQ ID NO: 7999 to 8182, preferably SEQ ID NO: 7999, 7800, 7801, 7802 or 7803, more preferably SEQ ID NO: 7999, 7800, 7801 or 7802, even more preferably SEQ ID NO: 7999 or 7800, most preferably SEQ ID NO: 7999 (first oligonucleotide) or any one of SEQ ID NO: 8183 to 8380, preferably SEQ ID NO: 8183, 8184, 8185 or 8186, more preferably SEQ ID NO: 8183 or 8184, even more preferably SEQ ID NO: 8183 (second oligonucleotide), or wherein all cytosine bases are 5-methylcytosine and all uracil bases are 5-methyluracil as represented by any one of SEQ ID NO: 10246 to 10428, preferably SEQ ID NO: 10246, 10247, 10248, 10249 or 10250, more preferably SEQ ID NO: 10246, 10247, 10248 or 10249, even more preferably SEQ ID NO: 10246 or 10247, most preferably SEQ ID NO: 10246 (first oligonucleotide) or any one of SEQ ID NO: 10429 to 10618, preferably SEQ ID NO: 10429, 10430, 10431 or 10432, more preferably SEQ ID NO: 10429 or 10430, even more preferably SEQ ID NO: 10429 (second oligonucleotide).

Throughout this application, whenever a SEQ ID NO references T or U and said monomer comprises a BNA scaffold modification, said monomer can optionally be replaced by U or T, respectively.

Throughout this application, a BNA scaffold modification can always be comprised in an oligonucleotide (i.e. a first and/or second antisense oligonucleotide present in the compound of the invention) unless explicitly stated otherwise. However, for the sake of legibility, this is not always explicitly spelt out. This means that whenever an oligonucleotide (i.e. a first and/or second antisense oligonucleotide present in the compound of the invention) is said to comprise or consist of only a particular kind of monomer, this does not exclude the presence of BNA scaffold modifications in cases where a BNA scaffold modification is mentioned as being present. For example, an oligonucleotide that consists of only 2'-O-methyl RNA monomers can nonetheless comprise a monomer with a BNA scaffold modification. This will be apparent from context (for example, when an AON is said to consist exclusively of one monomer, yet still also comprise a BNA scaffold modification).

An oligonucleotide of the invention, i.e. a first and/or second oligonucleotide of the compound, preferably comprises at least one of either a 5-methylcytosine base or a 5-methyluracil base, preferably all cytosine bases are 5-methylcytosine bases and/or all uracil bases are 5-methyluracil bases, and said oligonucleotide preferably comprises at least one 2'-O-methyl phosphorothioate monomer, more preferably comprises only 2'-O-methyl phosphorothioate monomers as defined earlier herein.

A first oligonucleotide and a second oligonucleotide of the compound of the invention each comprise terminal and non-terminal monomers. In the context of this application, terminal monomers of said first and/or second oligonucleotide are defined as monomers chosen from the group consisting of the 5'-terminal monomer and the 3'-terminal monomer of said first and/or second oligonucleotide, as explained earlier in this application. In a straightforward manner, non-terminal monomers of said first and/or second oligonucleotide are defined as monomers comprised in said first and/or second oligonucleotide which are not defined as terminal monomers. In the context of the invention, the term "terminal monomers" refers to the terminal monomers of a first oligonucleotide and/or a second oligonucleotide of the compound of the invention, and not to the terminal monomers of the compound as a whole, unless stated otherwise.

It is clear to the skilled person that both terminal and non-terminal monomers of a first oligonucleotide and/or a second oligonucleotide of the compound of the invention may comprise a BNA scaffold modification.

In preferred embodiment is provided a first and/or second oligonucleotide of the compound of the invention, wherein said first and/or second oligonucleotide comprises or consists of 1, 2, 3, 4, 5, 6, 7, 8 or 9 monomers, preferably 1, 2, 3, 4 or 5 monomers, that comprise a bicyclic nucleic acid (BNA) scaffold modification, preferably a bridged nucleic acid scaffold modification, more preferably a LNA modification, and preferably wherein said first and/or second oligonucleotide comprises or consists of 2'-O-substituted RNA monomers linked by phosphorothioate backbone linkages and/or wherein all cytosine bases are 5-methylcytosine and/or wherein all uracil bases are 5-methyluracil (i.e. thymine) in said first and/or second oligonucleotide as defined earlier herein.

In an even more preferred embodiment is provided a first and/or second oligonucleotide of the compound of the invention,
wherein:
(i) the 5'-terminal monomer of said first and/or second oligonucleotide comprises a BNA scaffold modification, or
(ii) the 3'-terminal monomer of said first and/or second oligonucleotide comprises a BNA scaffold modification, or
(iii) the 5'-terminal monomer and the 3'-terminal monomer of said first and/or second oligonucleotide comprise a BNA scaffold modification, or
(iv) the two most 5'-terminal monomers of said first and/or second oligonucleotide comprise a BNA scaffold modification, or
(v) the two most 3' terminal monomers of said first and/or second oligonucleotide comprise a BNA scaffold modification, or
(vi) the two most 5'-terminal monomers and the two most 3'-terminal monomers of said first and/or second oligonucleotide comprise a BNA scaffold modification;
and wherein said oligonucleotide comprises or consists of 1, 2, 3, 4 or 5 additional non-terminal monomers comprising a BNA scaffold modification, more preferably 1 or 2 additional non-terminal monomers comprising a BNA scaffold modification, wherein said additional non-terminal monomers preferably comprise an adenosine, an uracil and/or thymine base; more preferably a guanine, a cytosine and/or a 5-methylcytosine base. Preferably, a BNA scaffold modification is preferably an LNA modification.

When a first oligonucleotide and/or a second oligonucleotide of the compound of the invention comprises or consists of a sequence represented by any one of SEQ ID NOs: 14 to 197 (first oligonucleotide) or any one of SEQ ID NO: 198 to 398 (second oligonucleotide), preferably one or two non-terminal monomers comprise a BNA scaffold modification and optionally 1, 2, 3, 4 or 5 additional monomers comprise a BNA scaffold modification, more preferably only one or two non-terminal monomer of said oligonucleotide comprises a BNA scaffold modification, and preferably wherein said first and/or second oligonucleotide comprises or consists of 2'-O-substituted RNA monomers linked by phosphorothioate backbone linkages and/or wherein all cytosine bases are 5-methylcytosine and/or wherein all uracil bases are 5-methyluracil bases in said first and/or second oligonucleotide as defined earlier herein. Preferably, said non-terminal monomers comprising a BNA scaffold modification comprise an adenosine, uracil and/or thymine base. More preferably, said non-terminal monomers comprising a BNA scaffold modification comprise a guanine base, a cytosine base or a 5-methylcytosine base.

Preferred variants of said first and/or second oligonucleotide of the compound comprise or consist of a sequence represented by any one of SEQ ID NO: 14, 15, 16 or 17, preferably SEQ ID NO: 14 or 15, more preferably SEQ ID NO: 14 (first oligonucleotide); or any one of SEQ ID NO: 198 or 199, preferably SEQ ID NO: 198 (second oligonucleotide), or a fragment thereof as earlier defined herein, wherein said non-terminal monomer comprising a BNA scaffold modification comprises a guanine base, a cytosine base or a 5-methylcytosine base. As such, these preferred variants of the first oligonucleotide and/or the second oligonucleotide of the compound of the invention a) comprise only one monomer comprising a BNA scaffold modification, wherein said monomer is a non-terminal monomer comprising a guanine or a cytosine base, wherein said first and/or second oligonucleotide can be represented by any one of SEQ ID NO 10619 to 10625 (derived from SEQ ID NO: 14), 10626 to 10632 (derived from SEQ ID NO: 15), 10633 to 10640 (derived from SEQ ID NO: 16), or 10641 to 10650 (derived from SEQ ID NO: 17), preferably 10619 to 10625 or 10626 to 10632, more preferably 10619 to 10625 (first oligonucleotide), or 10766 to 10773 (derived from SEQ ID NO: 198) or 10774 to 10781 (derived from SEQ ID NO: 199), more preferably 10766 to 10773 (second oligonucleotide), preferably
  i. wherein all cytosine bases of said first and/or second oligonucleotide are 5-methylcytosine, as represented by SEQ ID NO: 10838 to 10844 (derived from SEQ ID NO: 14), 10845 to 10851 (derived from SEQ ID NO: 15), 10852 to 10859 (derived from SEQ ID NO: 16), or 10860 to 10869 (derived from SEQ ID NO: 17), preferably 10838 to 10844 or 10845 to 10851, more preferably 10838 to 10844 (first oligonucleotide); or 10985 to 10992 (derived from SEQ ID NO: 198) or 10993 to 11000 (derived from SEQ ID NO: 199), more preferably 10985 to 10992 (second oligonucleotide), or
  ii. wherein all uracil bases of said first and/or second oligonucleotide are 5-methyluracil, as represented by SEQ ID NO: 11057 to 11063 (derived from SEQ ID NO: 14), 11064 to 11070 (derived from SEQ ID NO: 15), 11071 to 11078 (derived from SEQ ID NO: 16), or 11079 to 11088 (derived from SEQ ID NO: 17), preferably 11057 to 11063 or 11064 to 11070, more preferably 11057 to 11063 (first oligonucleotide); or 11204 to 11211 (derived from SEQ ID NO: 198) or 11212 to 11219 (derived from SEQ ID NO: 199), more preferably 11204 to 11211 (second oligonucleotide), or
  iii. wherein all cytosine bases of said first and/or second oligonucleotide are 5-methylcytosine and all uracil bases of said first and/or second oligonucleotide are 5-methyluracil, as represented by SEQ ID NO: 11276 to 11282 (derived from SEQ ID NO: 14), 11283 to 11289 (derived from SEQ ID NO: 15), 11290 to 11297 (derived from SEQ ID NO: 16) or 11298 to 11307 (derived from SEQ ID NO: 17), preferably 11276 to 11282 or 11283 to 11289, more preferably 11276 to 11282 (first oligonucleotide); or 11423 to 11430 (derived from SEQ ID NO: 198) or 11431 to 11438 (derived from SEQ ID NO: 199), more preferably 11423 to 11430 (second oligonucleotide); or b) comprise only two monomers comprising a BNA scaffold modification, wherein said monomer is a non-terminal monomer comprising a guanine or a cytosine base, wherein said first and/or second oligonucleotide can be represented by any one of SEQ ID NO 10651 to 10671 (derived from SEQ ID NO: 14), 10672 to 10692 (derived from SEQ ID NO: 15), 10693 to 10720 (derived from SEQ ID NO: 16), or 10721 to 10765 (derived from SEQ ID NO: 17), preferably 10651 to 10671 or 10672 to 10692, more preferably 10651 to 10671 (first oligonucleotide), or 10782 to 10809 (derived from SEQ ID NO: 198) or 10810 to 10837 (derived from SEQ ID NO: 199), more preferably 10782 to 10809 (second oligonucleotide), preferably
  i. wherein all cytosine bases of said first and/or second oligonucleotide are 5-methylcytosine, as represented by SEQ ID NO: 10870 to 10890 (derived from SEQ ID NO: 14), 10891 to 10911 (derived from SEQ ID NO: 15), 10912 to 10939 (derived from SEQ ID NO: 16), or 10940 to 10984 (derived from SEQ ID NO: 17), preferably 10870 to 10890 or 10891 to 10911, more preferably 10870 to 10890 (first oligonucleotide); or 11001 to 11028 (derived from SEQ ID NO: 198) or 11029 to 11056 (derived from SEQ ID NO: 199), more preferably 11001 to 11028 (second oligonucleotide), or
  ii. wherein all uracil bases of said first and/or second oligonucleotide are 5-methyluracil, as represented by SEQ ID NO: 11089 to 11109 (derived from SEQ ID NO: 14), 11110 to 11130 (derived from SEQ ID NO: 15), 11131 to 11158 (derived from SEQ ID NO: 16), or 11159 to 11203 (derived from SEQ ID NO: 17), preferably 11089 to 11109 or 11110 to 11130, more preferably 11089 to 11109 (first oligonucleotide); or 11220 to 11247 (derived from SEQ ID NO: 198) or 11248 to 11275 (derived from SEQ ID NO: 199), more preferably 11220 to 11247 (second oligonucleotide), or
  iii. wherein all cytosine bases of said first and/or second oligonucleotide are 5-methylcytosine and all uracil bases of said first and/or second oligonucleotide are 5-methyluracil, as represented by SEQ ID NO: 11308 to 11328 (derived from SEQ ID NO: 14), 11329 to 11349 (derived from SEQ ID NO: 15), 11350 to 11377 (derived from SEQ ID NO: 16) or 11378 to 11422 (derived from SEQ ID NO: 17), preferably 11308 to 11328 or 11329 to 11349, more preferably 11308 to 11328 (first oligonucleotide); or 11439 to 11466 (derived from SEQ ID NO: 198) or 11467 to 11494 (derived from SEQ ID NO: 199), more preferably 11439 to 11466 (second oligonucleotide).

When a first oligonucleotide and/or a second oligonucleotide of the compound of the invention comprises or consists of a sequence represented by any one of SEQ ID NO: 14 to 197 (first oligonucleotide) or any one of SEQ ID NO: 198 to 398 (second oligonucleotide), wherein the 5' terminal monomer and/or the 3' terminal monomer and/or the two most 5'-terminal monomers and/or the two most 3'-terminal monomers comprise a BNA scaffold modification, preferably one or two non-terminal monomers comprise a BNA scaffold modification and optionally 1, 2, 3, 4 or 5 additional non-terminal monomers comprise a BNA scaffold modification, more preferably only one or two non-terminal monomers of said first and/or second oligonucleotide comprises a BNA scaffold modification, and preferably wherein said oligonucleotide comprises or consists of 2'-O-substituted RNA monomers linked by phosphorothioate backbone linkages and/or wherein all cytosine bases are 5-methylcytosine and/or wherein all uracil bases are 5-methyluracil bases in said first and/or second oligonucleotide. Preferably, said non-terminal monomer comprising a BNA scaffold modification comprises an adenosine base, an uracil or a thymine base. More preferably, said non-terminal monomer comprising a BNA scaffold modification comprises a guanine base, a cytosine base or a 5-methylcytosine base.

Preferred variants of said first and/or second oligonucleotide of the compound comprise or consist of a sequence represented by any one of SEQ ID NO: 14, 15, 16 or 17, preferably SEQ ID NO: 14 or 15, more preferably SEQ ID NO: 14 (first oligonucleotide) or any one of SEQ ID NO: 198 or 199, preferably SEQ ID NO: 198 (second oligonucleotide), or a fragment thereof as earlier defined herein, preferably wherein said non-terminal monomer comprising a BNA scaffold modification comprises an adenosine base, an uracil or a thymine base, more preferably wherein said non-terminal monomer comprising a BNA scaffold modification comprises a guanine base, a cytosine base or a 5-methylcytosine base. Most preferred variants of said first and/or second oligonucleotide of the compound are those oligonucleotides which comprise or consist of a sequence represented by any one of SEQ ID NO: 14, 15, 16 or 17, preferably SEQ ID NO: 14 or 15, more preferably SEQ ID NO: 14 (first oligonucleotide) or any one of SEQ ID NO: 198 or 199, preferably SEQ ID NO: 198 (second oligonucleotide), wherein said non-terminal monomers comprising a BNA scaffold modification comprise a guanine base, a cytosine base or a 5-methylcytosine base, and a) wherein the 5' terminal monomer and one non-terminal monomer of said first and/or second oligonucleotide comprise a BNA scaffold modification, as represented by any one of SEQ ID NO: 11495 to 11500 (derived from SEQ ID NO: 14), 11501 to 11507 (derived from SEQ ID NO: 15), 11508 to 11514 (derived from SEQ ID NO: 16) or 11515 to 11524 (derived from SEQ ID NO: 17), preferably 11495 to 11500 or 11501 to 11507, more preferably 11495 to 11500 (first oligonucleotide); or 11627 to 11633 (derived from SEQ ID NO: 198) or 11634 to 11640 (derived from SEQ ID NO: 199), more preferably 11627 to 11633 (second oligonucleotide), preferably i. wherein all cytosine bases of said first and/or second oligonucleotide are 5-methylcytosine, as represented by SEQ ID NO: 11683 to 11688 (derived from SEQ ID NO: 14), 11689 to 11695 (derived from SEQ ID NO: 15), 11696 to 11702 (derived from SEQ ID NO: 16) or 11703 to 11712 (derived from SEQ ID NO: 17), preferably 11683 to 11688 or 11689 to 11695, more preferably 11683 to 11688 (first oligonucleotide); or 11815 to 11821 (derived from SEQ ID NO: 198) or 11822 to 11828 (derived from SEQ ID NO: 199), more preferably 11815 to 11821 (second oligonucleotide), or ii. wherein all uracil bases of said first and/or second oligonucleotide are 5-methyluracil, as represented by SEQ ID NO: 11871 to 11876 (derived from SEQ ID NO: 14), 11877 to 11883 (derived from SEQ ID NO: 15), 11884 to 11890 (derived from SEQ ID NO: 16) or 11891 to 11900 (derived from SEQ ID NO: 17), preferably 11871 to 11876 or 11877 to 11883, more preferably 11871 to 11876 (first oligonucleotide); or 12003 to 12009 (derived from SEQ ID NO: 198) or 12010 to 12016 (derived from SEQ ID NO: 199), more preferably 12003 to 12009 (second oligonucleotide), or iii. wherein all cytosine bases of said first and/or second oligonucleotide are 5-methylcytosine and all uracil bases of said first and/or second oligonucleotide are 5-methyluracil, as represented by SEQ ID NO: 12059 to 12064 (derived from SEQ ID NO: 14), 12065 to 12071 (derived from SEQ ID NO: 15), 12072 to 12078 (derived from SEQ ID NO: 16) or 12079 to 12088 (derived from SEQ ID NO: 17), preferably 12059 to 12064 or 12065 to 12071, more preferably 12059 to 12064 (first oligonucleotide); or 12191 to 12197 (derived from SEQ ID NO: 198) or 12198 to 12204 (derived from SEQ ID NO: 199), more preferably 12191 to 12197 (second oligonucleotide); or b) wherein the 5' terminal monomer and two non-terminal monomers of said first and/or second oligonucleotide comprise a BNA scaffold modification, as represented by any one of SEQ ID NO: 11525 to 11539 (derived from SEQ ID NO: 14), 11540 to 11560 (derived from SEQ ID NO: 15), 11561 to 11581 (derived from SEQ ID NO: 16) or 11582 to 11626 (derived from SEQ ID NO: 17), preferably 11525 to 11539 or 11540 to 11560, more preferably 11525 to 11539 (first oligonucleotide); or 11641 to 11661 (derived from SEQ ID NO: 198) or 11662 to 11682 (derived from SEQ ID NO: 199), more preferably 11641 to 11661 (second oligonucleotide), preferably i. wherein all cytosine bases of said first and/or second oligonucleotide are 5-methylcytosine, as represented by SEQ ID NO: 11713 to 11727 (derived from SEQ ID NO: 14), 11728 to 11748 (derived from SEQ ID NO: 15), 11749 to 11769 (derived from SEQ ID NO: 16) or 11770 to 11814 (derived from SEQ ID NO: 17), preferably 11713 to 11727 or 11728 to 11748, more preferably 11713 to 11727 (first oligonucleotide); or 11829 to 11849 (derived from SEQ ID NO: 198) or 11850 to 11870 (derived from SEQ ID NO: 199), more preferably 11829 to 11849 (second oligonucleotide), or ii. wherein all uracil bases of said first and/or second oligonucleotide are 5-methyluracil, as represented by SEQ ID NO: 11901 to 11915 (derived from SEQ ID NO: 14), 11916 to 11936 (derived from SEQ ID NO: 15), 11937 to 11957 (derived from SEQ ID NO: 16) or 11958 to 12002 (derived from SEQ ID NO: 17), preferably 11901 to 11915 or 11916 to 11936, more preferably 11901 to 11915 (first oligonucleotide); or 12017 to 12037 (derived from SEQ ID NO: 198) or 12038 to 12058 (derived from SEQ ID NO: 199), more preferably 12017 to 12037 (second oligonucleotide), or iii. wherein all cytosine bases of said first and/or second oligonucleotide are 5-methylcytosine and all uracil bases of said first and/or second oligonucleotide are 5-methyluracil, as represented by SEQ ID NO:

12089 to 12103 (derived from SEQ ID NO: 14), 12104 to 12124 (derived from SEQ ID NO: 15), 12125 to 12145 (derived from SEQ ID NO: 16) or 12146 to 12190 (derived from SEQ ID NO: 17), preferably 12089 to 12103 or 12104 to 12124, more preferably 12089 to 12103 (first oligonucleotide); or 12205 to 12225 (derived from SEQ ID NO: 198) or 12226 to 12246 (derived from SEQ ID NO: 199), more preferably 12205 to 12225 (second oligonucleotide); or c) wherein the 3' terminal monomer and one non-terminal monomer of said first and/or second oligonucleotide comprise a BNA scaffold modification, as represented by any one of SEQ ID NO: 12247 to 12252 (derived from SEQ ID NO: 14), 12253 to 12258 (derived from SEQ ID NO: 15), 12259 to 12265 (derived from SEQ ID NO: 16) or 12266 to 12274 (derived from SEQ ID NO: 17), preferably 12247 to 12252 or 12253 to 12258, more preferably 12247 to 12252 (first oligonucleotide); or 12362 to 12368 (derived from SEQ ID NO: 198) or 12369 to 12376 (derived from SEQ ID NO: 199), more preferably 12362 to 12368 (second oligonucleotide), preferably
  i. wherein all cytosine bases of said first and/or second oligonucleotide are 5-methylcytosine, as represented by SEQ ID NO: 12426 to 12431 (derived from SEQ ID NO: 14), 12432 to 12437 (derived from SEQ ID NO: 15), 12438 to 12444 (derived from SEQ ID NO: 16) or 12445 to 12453 (derived from SEQ ID NO: 17), preferably 12426 to 12431 or 12432 to 12437, more preferably 12426 to 12431 (first oligonucleotide); or 12541 to 12547 (derived from SEQ ID NO: 198) or 12548 to 12555 (derived from SEQ ID NO: 199), more preferably 12541 to 12547 (second oligonucleotide), or
  ii. wherein all uracil bases of said first and/or second oligonucleotide are 5-methyluracil, as represented by SEQ ID NO: 12605 to 12610 (derived from SEQ ID NO: 14), 12611 to 12616 (derived from SEQ ID NO: 15), 12617 to 12623 (derived from SEQ ID NO: 16) or 12624 to 12632 (derived from SEQ ID NO: 17), preferably 12605 to 12610 or 12611 to 12616, more preferably 12605 to 12610 (first oligonucleotide); or 12720 to 12726 (derived from SEQ ID NO: 198) or 12727 to 12734 (derived from SEQ ID NO: 199), more preferably 12720 to 12726 (second oligonucleotide), or
  iii. wherein all cytosine bases of said first and/or second oligonucleotide are 5-methylcytosine and all uracil bases of said first and/or second oligonucleotide are 5-methyluracil, as represented by SEQ ID NO: 12784 to 12789 (derived from SEQ ID NO: 14), 12790 to 12795 (derived from SEQ ID NO: 15), 12796 to 12802 (derived from SEQ ID NO: 16) or 12803 to 12811 (derived from SEQ ID NO: 17), preferably 12784 to 12789 or 12790 to 12795, more preferably 12784 to 12789 (first oligonucleotide); or 12899 to 12905 (derived from SEQ ID NO: 198) or 12906 to 12913 (derived from SEQ ID NO: 199), more preferably 12899 to 12905 (second oligonucleotide); or d) wherein the 3' terminal monomer and two non-terminal monomers of said first and/or second oligonucleotide comprise a BNA scaffold modification, as represented by any one of SEQ ID NO: 12275 to 12289 (derived from SEQ ID NO: 14), 12290 to 12304 (derived from SEQ ID NO: 15), 12305 to 12325 (derived from SEQ ID NO: 16) or 12326 to 12361 (derived from SEQ ID NO: 17), preferably 12275 to 12289 or 12290 to 12304, more preferably 12275 to 12289 (first oligonucleotide); or 12377 to 12397 (derived from SEQ ID NO: 198) or 12398 to 12425 (derived from SEQ ID NO: 199), more preferably 12377 to 12397 (second oligonucleotide), preferably
  i. wherein all cytosine bases of said first and/or second oligonucleotide are 5-methylcytosine, as represented by SEQ ID NO: 12454 to 12468 (derived from SEQ ID NO: 14), 12469 to 12483 (derived from SEQ ID NO: 15), 12484 to 12504 (derived from SEQ ID NO: 16) or 12505 to 12540 (derived from SEQ ID NO: 17), preferably 12454 to 12468 or 12469 to 12483, more preferably 12454 to 12468 (first oligonucleotide); or 12556 to 12576 (derived from SEQ ID NO: 198) or 12577 to 12604 (derived from SEQ ID NO: 199), more preferably 12556 to 12576 (second oligonucleotide), or
  ii. wherein all uracil bases of said first and/or second oligonucleotide are 5-methyluracil, as represented by SEQ ID NO: 12633 to 12647 (derived from SEQ ID NO: 14), 12648 to 12662 (derived from SEQ ID NO: 15), 12663 to 12683 (derived from SEQ ID NO: 16) or 12684 to 12719 (derived from SEQ ID NO: 17), preferably 12633 to 12647 or 12648 to 12662, more preferably 12633 to 12647 (first oligonucleotide); or 12735 to 12755 (derived from SEQ ID NO: 198) or 12756 to 12783 (derived from SEQ ID NO: 199), more preferably 12735 to 12755 (second oligonucleotide), or
  iii. wherein all cytosine bases of said first and/or second oligonucleotide are 5-methylcytosine and all uracil bases of said oligonucleotide are 5-methyluracil, as represented by SEQ ID NO: 12812 to 12826 (derived from SEQ ID NO: 14), 12827 to 12841 (derived from SEQ ID NO: 15), 12842 to 12862 (derived from SEQ ID NO: 16) or 12863 to 12898 (derived from SEQ ID NO: 17), preferably 12812 to 12826 or 12827 to 12841, more preferably 12812 to 12826 (first oligonucleotide); or 12914 to 12934 (derived from SEQ ID NO: 198) or 12935 to 12962 (derived from SEQ ID NO: 199), more preferably 12914 to 12934 (second oligonucleotide); or e) wherein the 5' terminal monomer, the 3' terminal monomer and one non-terminal monomer of said first and/or second oligonucleotide comprise a BNA scaffold modification, as represented by any one of SEQ ID NO: 12963 to 12969 (derived from SEQ ID NO: 14), 12970 to 12976 (derived from SEQ ID NO: 15), 12977 to 12984 (derived from SEQ ID NO: 16) or 12985 to 12994 (derived from SEQ ID NO: 17), preferably 12963 to 12969 or 12970 to 12976, more preferably 12963 to 12969 (first oligonucleotide); or 13110 to 13117 (derived from SEQ ID NO: 198) or 13118 to 13125 (derived from SEQ ID NO: 199), more preferably 13110 to 13117 (second oligonucleotide), preferably
  i. wherein all cytosine bases of said first and/or second oligonucleotide are 5-methylcytosine, as represented by SEQ ID NO: 13182 to 13188 (derived from SEQ ID NO: 14), 13189 to 13195 (derived from SEQ ID NO: 15), 13196 to 13203 (derived from SEQ ID NO: 16) or 13204 to 13213 (derived from SEQ ID NO: 17), preferably 13182 to 13188 or 13189 to 13195, more preferably 13182 to 13188 (first oligonucleotide); or 13329 to 13336 (derived from SEQ ID NO:

198) or 13337 to 13344 (derived from SEQ ID NO: 199), more preferably 13329 to 13336 (second oligonucleotide), or ii. wherein all uracil bases of said first and/or second oligonucleotide are 5-methyluracil, as represented by SEQ ID NO: 13401 to 13407 (derived from SEQ ID NO: 14), 13408 to 13414 (derived from SEQ ID NO: 15), 13415 to 13422 (derived from SEQ ID NO: 16) or 13423 to 13432 (derived from SEQ ID NO: 17), preferably 13401 to 13407 or 13408 to 13414, more preferably 13401 to 13407 (first oligonucleotide); or 13548 to 13555 (derived from SEQ ID NO: 198) or 13556 to 13563 (derived from SEQ ID NO: 199), more preferably 13548 to 13555 (second oligonucleotide), or iii. wherein all cytosine bases of said first and/or second oligonucleotide are 5-methylcytosine and all uracil bases of said first and/or second oligonucleotide are 5-methyluracil, as represented by SEQ ID NO: 13620 to 13626 (derived from SEQ ID NO: 14), 13627 to 13633 (derived from SEQ ID NO: 15), 13634 to 13641 (derived from SEQ ID NO: 16) or 13642 to 13651 (derived from SEQ ID NO: 17), preferably 13620 to 13626 or 13627 to 13633, more preferably 13620 to 13626 (first oligonucleotide); or 13767 to 13774 (derived from SEQ ID NO: 198) or 13775 to 13782 (derived from SEQ ID NO: 199), more preferably 13767 to 13774 (second oligonucleotide); or f) wherein the 5' terminal monomer, the 3' terminal monomer and two non-terminal monomers of said first and/or second oligonucleotide comprise a BNA scaffold modification, as represented by any one of SEQ ID NO: 12995 to 13015 (derived from SEQ ID NO: 14), 13016 to 13036 (derived from SEQ ID NO: 15), 13037 to 13064 (derived from SEQ ID NO: 16) or 13065 to 13109 (derived from SEQ ID NO: 17), preferably 12995 to 13015 or 13016 to 13036, more preferably 12995 to 13015 (first oligonucleotide); or 13126 to 13153 (derived from SEQ ID NO: 198) or 13154 to 13181 (derived from SEQ ID NO: 199), more preferably 13126 to 13153 (second oligonucleotide), preferably i. wherein all cytosine bases of said first and/or second oligonucleotide are 5-methylcytosine, as represented by SEQ ID NO: 13214 to 13234 (derived from SEQ ID NO: 14), 13235 to 13255 (derived from SEQ ID NO: 15), 13256 to 13283 (derived from SEQ ID NO: 16) or 13284 to 13328 (derived from SEQ ID NO: 17), preferably 13214 to 13234 or 13235 to 13255, more preferably 13214 to 13234 (first oligonucleotide); or 13345 to 13372 (derived from SEQ ID NO: 198) or 13373 to 13400 (derived from SEQ ID NO: 199), more preferably 13345 to 13372 (second oligonucleotide), or ii. wherein all uracil bases of said first and/or second oligonucleotide are 5-methyluracil, as represented by SEQ ID NO: 13433 to 13453 (derived from SEQ ID NO: 14), 13454 to 13474 (derived from SEQ ID NO: 15), 13475 to 13502 (derived from SEQ ID NO: 16) or 13503 to 13547 (derived from SEQ ID NO: 17), preferably 13433 to 13453 or 13454 to 13474, more preferably 13433 to 13453 (first oligonucleotide); or 13564 to 13591 (derived from SEQ ID NO: 198) or 13592 to 13619 (derived from SEQ ID NO: 199), more preferably 13564 to 13591 (second oligonucleotide), or iii. wherein all cytosine bases of said first and/or second oligonucleotide are 5-methylcytosine and all uracil bases of said first and/or second oligonucleotide are 5-methyluracil, as represented by SEQ ID NO: 13652 to 13672 (derived from SEQ ID NO: 14), 13673 to 13693 (derived from SEQ ID NO: 15), 13694 to 13721 (derived from SEQ ID NO: 16) or 13722 to 13766 (derived from SEQ ID NO: 17), preferably 13652 to 13672 or 13673 to 13693, more preferably 13652 to 13672 (first oligonucleotide); or 13783 to 13810 (derived from SEQ ID NO: 198) or 13811 to 13838 (derived from SEQ ID NO: 199), more preferably 13783 to 13810 (second oligonucleotide); or g) wherein the two most 5'-terminal monomers and one non-terminal monomer of said first and/or second oligonucleotide comprise a BNA scaffold modification, as represented by any one of SEQ ID NO: 13839 to 13844 (derived from SEQ ID NO: 14), 13845 to 13851 (derived from SEQ ID NO: 15), 13852 to 13858 (derived from SEQ ID NO: 16) or 13859 to 13868 (derived from SEQ ID NO: 17), preferably 13839 to 13844 or 13845 to 13851, more preferably 13839 to 13844 (first oligonucleotide), or 13971 to 13977 (derived from SEQ ID NO: 198) or 13978 to 13984 (derived from SEQ ID NO: 199), more preferably 13971 to 13977 (second oligonucleotide), preferably i. wherein all cytosine bases of said first and/or second oligonucleotide are 5-methylcytosine, as represented by SEQ ID NO: 14027 to 14032 (derived from SEQ ID NO: 14), 14033 to 14039 (derived from SEQ ID NO: 15), 14040 to 14046 (derived from SEQ ID NO: 16) or 14047 to 14056 (derived from SEQ ID NO: 17), preferably 14027 to 14032 or 14033 to 14039, more preferably 14027 to 14032 (first oligonucleotide), or 14159 to 14165 (derived from SEQ ID NO: 198) or 14166 to 14172 (derived from SEQ ID NO: 199), more preferably 14159 to 14165 (second oligonucleotide), or ii. wherein all uracil bases of said first and/or second oligonucleotide are 5-methyluracil, as represented by SEQ ID NO: 14215 to 14220 (derived from SEQ ID NO: 14), 14221 to 14227 (derived from SEQ ID NO: 15), 14228 to 14234 (derived from SEQ ID NO: 16) or 14235 to 14244 (derived from SEQ ID NO: 17), preferably 14215 to 14220 or 14221 to 14227, more preferably 14215 to 14220 (first oligonucleotide), or 14347 to 14353 (derived from SEQ ID NO: 198) or 14354 to 14360 (derived from SEQ ID NO: 199), more preferably 14347 to 14353 (second oligonucleotide), or iii. wherein all cytosine bases of said first and/or second oligonucleotide are 5-methylcytosine and all uracil bases of said first and/or second oligonucleotide are 5-methyluracil, as represented by SEQ ID NO: 14403 to 14408 (derived from SEQ ID NO: 14), 14409 to 14415 (derived from SEQ ID NO: 15), 14416 to 14422 (derived from SEQ ID NO: 16) or 14423 to 14432 (derived from SEQ ID NO: 17), preferably 14403 to 14408 or 14409 to 14415, more preferably 14403 to 14408 (first oligonucleotide), or 14535 to 14541 (derived from SEQ ID NO: 198) or 14542 to 14548 (derived from SEQ ID NO: 199), more preferably 14535 to 14541 (second oligonucleotide); or h) wherein the two most 5'-terminal monomers and two non-terminal monomers of said first and/or second oligonucleotide comprise a BNA scaffold modification, as represented by any one of SEQ ID NO: 13869 to 13883 (derived from SEQ ID NO: 14), 13884 to 13904 (derived from SEQ ID NO: 15), 13905 to 13925 (derived from SEQ ID NO: 16) or 13926 to 13970 (derived from SEQ ID NO: 17), preferably 13869 to 13883 or 13884 to 13904, more preferably 13869 to 13883 (first oligonucleotide); or 13985 to 14005 (derived from SEQ ID NO: 198) or 14006 to 14026 (derived from SEQ ID NO: 199), more preferably 13985 to 14005 (second oligonucleotide), preferably i. wherein all cytosine bases of said first and/or second oligonucleotide are 5-methylcytosine, as represented by SEQ ID NO: 14057 to 14071 (derived from SEQ ID NO: 14), 14072 to 14092 (derived from SEQ ID NO: 15), 14093 to 14113 (derived from SEQ ID NO: 16) or 14114 to 14158 (derived from SEQ ID NO: 17), preferably 14057 to 14071 or 14072 to 14092, more preferably 14057 to 14071 (first oligonucleotide); or 14173 to 14193 (derived from SEQ ID NO: 198) or 14194 to 14214 (derived from SEQ ID NO: 199), more preferably 14173 to 14193 (second oligonucleotide), or ii. wherein all uracil bases of said first and/or second oligonucleotide are 5-methyluracil, as represented by SEQ ID NO: 14245 to 14259 (derived from SEQ ID NO: 14), 14260 to 14280 (derived from SEQ ID NO: 15), 14281 to 14301 (derived from SEQ ID NO: 16) or 14302 to 14346 (derived from SEQ ID NO: 17), preferably 14245 to 14259 or 14260 to 14280, more preferably 14245 to 14259 (first oligonucleotide); or 14361 to 14381 (derived from SEQ ID NO: 198) or 14382 to 14402 (derived from SEQ ID NO: 199), more preferably 14361 to 14381 (second oligonucleotide), or iii. wherein all cytosine bases of said first and/or second oligonucleotide are 5-methylcytosine and all uracil bases of said first and/or second oligonucleotide are 5-methyluracil, as represented by SEQ ID NO: 14433 to 14447 (derived from SEQ ID NO: 14), 14448 to 14468 (derived from SEQ ID NO: 15), 14469 to 14489 (derived from SEQ ID NO: 16) or 14490 to 14534 (derived from SEQ ID NO: 17), preferably 14433 to 14447 or 14448 to 14468, more preferably 14433 to 14447 (first oligonucleotide); or 14549 to 14569 (derived from SEQ ID NO: 198) or 14570 to 14590 (derived from SEQ ID NO: 199), more preferably 14549 to 14569 (second oligonucleotide); or i) wherein the two most 3'-terminal monomers and one non-terminal monomer of said first and/or second oligonucleotide comprise a BNA scaffold modification, as represented by any one of SEQ ID NO: 14591 to 14596 (derived from SEQ ID NO: 14), 14597 to 14602 (derived from SEQ ID NO: 15), 14603 to 14609 (derived from SEQ ID NO: 16) or 14610 to 14618 (derived from SEQ ID NO: 17), preferably 14591 to 14596 or 14597 to 14602, more preferably 14591 to 14596 (first oligonucleotide); or 14706 to 14712 (derived from SEQ ID NO: 198) or 14713 to 14720 (derived from SEQ ID NO: 199), more preferably 14706 to 14712 (second oligonucleotide), preferably i. wherein all cytosine bases of said first and/or second oligonucleotide are 5-methylcytosine, as represented by SEQ ID NO: 14770 to 14775 (derived from SEQ ID NO: 14), 14776 to 14781 (derived from SEQ ID NO: 15), 14782 to 14788 (derived from SEQ ID NO: 16) or 14789 to 14797 (derived from SEQ ID NO: 17), preferably 14770 to 14775 or 14776 to 14781, more preferably 14770 to 14775 (first oligonucleotide); or 14885 to 14891 (derived from SEQ ID NO: 198) or 14892 to 14899 (derived from SEQ ID NO: 199), more preferably 14885 to 14891 (second oligonucleotide), or ii. wherein all uracil bases of said first and/or second oligonucleotide are 5-methyluracil, as represented by SEQ ID NO: 14949 to 14954 (derived from SEQ ID NO: 14), 14955 to 14960 (derived from SEQ ID NO: 15), 14961 to 14967 (derived from SEQ ID NO: 16) or 14968 to 14976 (derived from SEQ ID NO: 17), preferably 14949 to 14954 or 14955 to 14960, more preferably 14949 to 14954 (first oligonucleotide); or 15064 to 15070 (derived from SEQ ID NO: 198) or 15071 to 15078 (derived from SEQ ID NO: 199), more preferably 15064 to 15070 (second oligonucleotide), or iii. wherein all cytosine bases of said first and/or second oligonucleotide are 5-methylcytosine and all uracil bases of said first and/or second oligonucleotide are 5-methyluracil, as represented by SEQ ID NO: 15128 to 15133 (derived from SEQ ID NO: 14), 15134 to 15139 (derived from SEQ ID NO: 15), 15140 to 15146 (derived from SEQ ID NO: 16) or 15147 to 15155 (derived from SEQ ID NO: 17), preferably 15128 to 15133 or 15134 to 15139, more preferably 15128 to 15133 (first oligonucleotide); or 15243 to 15249 (derived from SEQ ID NO: 198) or 15250 to 15257 (derived from SEQ ID NO: 199), more preferably 15243 to 15249 (second oligonucleotide); or j) wherein the two most 3'-terminal monomers and two non-terminal monomers of said first and/or second oligonucleotide comprise a BNA scaffold modification, as represented by any one of SEQ ID NO: 14619 to 14633 (derived from SEQ ID NO: 14), 14634 to 14648 (derived from SEQ ID NO: 15), 14649 to 14669 (derived from SEQ ID NO: 16) or 14670 to 14705 (derived from SEQ ID NO: 17), preferably 14619 to 14633 or 14634 to 14648, more preferably 14619 to 14633 (first oligonucleotide); or 14721 to 14741 (derived from SEQ ID NO: 198) or 14742 to 14769 (derived from SEQ ID NO: 199), more preferably 14721 to 14741 (second oligonucleotide), preferably i. wherein all cytosine bases of said first and/or second oligonucleotide are 5-methylcytosine, as represented by SEQ ID NO: 14798 to 14812 (derived from SEQ ID NO: 14), 14813 to 14827 (derived from SEQ ID NO: 15), 14828 to 14848 (derived from SEQ ID NO: 16) or 14849 to 14884 (derived from SEQ ID NO: 17), preferably 14798 to 14812 or 14813 to 14827, more preferably 14798 to 14812 (first oligonucleotide); or 14900 to 14920 (derived from SEQ ID NO: 198) or 14921 to 14948 (derived from SEQ ID NO: 199), more preferably 14900 to 14920 (second oligonucleotide), or ii. wherein all uracil bases of said first and/or second oligonucleotide are 5-methyluracil, as represented by SEQ ID NO: 14977 to 14991 (derived from SEQ ID NO: 14), 14992 to 15006 (derived from SEQ ID NO: 15), 15007 to 15027 (derived from SEQ ID NO: 16) or 15028 to 15063 (derived from SEQ ID NO: 17), preferably 14977 to 14991 or 14992 to 15006, more preferably 14977 to 14991 (first oligonucleotide); or 15079 to 15099 (derived from SEQ ID NO:

198) or 15100 to 15127 (derived from SEQ ID NO: 199), more preferably 15079 to 15099 (second oligonucleotide), or iii. wherein all cytosine bases of said first and/or second oligonucleotide are 5-methylcytosine and all uracil bases of said first and/or second oligonucleotide are 5-methyluracil, as represented by SEQ ID NO: 15156 to 15170 (derived from SEQ ID NO: 14), 15171 to 15185 (derived from SEQ ID NO: 15), 15186 to 15206 (derived from SEQ ID NO: 16) or 15207 to 15242 (derived from SEQ ID NO: 17), preferably 15156 to 15170 or 15171 to 15185, more preferably 15156 to 15170 (first oligonucleotide); or 15258 to 15278 (derived from SEQ ID NO: 198) or 15279 to 15306 (derived from SEQ ID NO: 199), more preferably 15258 to 15278 (second oligonucleotide); or k) wherein the two most 5'-terminal monomers, the two most 3'-terminal monomers and one non-terminal monomer of said first and/or second oligonucleotide comprise a BNA scaffold modification, as represented by any one of SEQ ID NO: 15307 to 15311 (derived from SEQ ID NO: 14), 15312 to 15317 (derived from SEQ ID NO: 15), 15318 to 15323 (derived from SEQ ID NO: 16) or 15324 to 15332 (derived from SEQ ID NO: 17), preferably 15307 to 15311 or 15312 to 15317, more preferably 15307 to 15311 (first oligonucleotide); or 15409 to 15414 (derived from SEQ ID NO: 198) or 15415 to 15421 (derived from SEQ ID NO: 199), more preferably 15409 to 15414 (second oligonucleotide), preferably i. wherein all cytosine bases of said first and/or second oligonucleotide are 5-methylcytosine, as represented by SEQ ID NO: 15458 to 15462 (derived from SEQ ID NO: 14), 15463 to 15468 (derived from SEQ ID NO: 15), 15469 to 15474 (derived from SEQ ID NO: 16) or 15475 to 15483 (derived from SEQ ID NO: 17), preferably 15458 to 15462 or 15463 to 15468, more preferably 15458 to 15462 (first oligonucleotide); or 15560 to 15565 (derived from SEQ ID NO: 198) or 15566 to 15572 (derived from SEQ ID NO: 199), more preferably 15560 to 15565 (second oligonucleotide), or ii. wherein all uracil bases of said first and/or second oligonucleotide are 5-methyluracil, as represented by SEQ ID NO: 15609 to 15613 (derived from SEQ ID NO: 14), 15614 to 15619 (derived from SEQ ID NO: 15), 15620 to 15625 (derived from SEQ ID NO: 16) or 15626 to 15634 (derived from SEQ ID NO: 17), preferably 15609 to 15613 or 15614 to 15619, more preferably 15609 to 15613 (first oligonucleotide); or 15711 to 15716 (derived from SEQ ID NO: 198) or 15717 to 15723 (derived from SEQ ID NO: 199), more preferably 15711 to 15716 (second oligonucleotide), or iii. wherein all cytosine bases of said first and/or second oligonucleotide are 5-methylcytosine and all uracil bases of said first and/or second oligonucleotide are 5-methyluracil, as represented by SEQ ID NO: 15760 to 15764 (derived from SEQ ID NO: 14), 15765 to 15770 (derived from SEQ ID NO: 15), 15771 to 15776 (derived from SEQ ID NO: 16) or 15777 to 15785 (derived from SEQ ID NO: 17), preferably 15760 to 15764 or 15765 to 15770, more preferably 15760 to 15764 (first oligonucleotide); or 15862 to 15867 (derived from SEQ ID NO: 198) or 15868 to 15874 (derived from SEQ ID NO: 199), more preferably 15862 to 15867 (second oligonucleotide); or l) wherein the two most 5'-terminal monomers, the two most 3'-terminal monomers and two non-terminal monomers of said first and/or second oligonucleotide comprise a BNA scaffold modification, as represented by any one of SEQ ID NO: 15333 to 15342 (derived from SEQ ID NO: 14), 15343 to 15357 (derived from SEQ ID NO: 15), 15358 to 15372 (derived from SEQ ID NO: 16) or 15373 to 15408 (derived from SEQ ID NO: 17), preferably 15333 to 15342 or 15343 to 15357, more preferably 15333 to 15342 (first oligonucleotide); or 15422 to 15436 (derived from SEQ ID NO: 198) or 15437 to 15457 (derived from SEQ ID NO: 199), more preferably 15422 to 15436 (second oligonucleotide), preferably i. wherein all cytosine bases of said first and/or second oligonucleotide are 5-methylcytosine, as represented by SEQ ID NO: 15484 to 15493 (derived from SEQ ID NO: 14), 15494 to 15508 (derived from SEQ ID NO: 15), 15509 to 15523 (derived from SEQ ID NO: 16) or 15524 to 15559 (derived from SEQ ID NO: 17), preferably 15484 to 15493 or 15494 to 15508, more preferably 15484 to 15493 (first oligonucleotide); or 15573 to 15587 (derived from SEQ ID NO: 198) or 15588 to 15608 (derived from SEQ ID NO: 199), more preferably 15573 to 15587 (second oligonucleotide), or ii. wherein all uracil bases of said first and/or second oligonucleotide are 5-methyluracil, as represented by SEQ ID NO: 15635 to 15644 (derived from SEQ ID NO: 14), 15645 to 15659 (derived from SEQ ID NO: 15), 15660 to 15674 (derived from SEQ ID NO: 16) or 15675 to 15710 (derived from SEQ ID NO: 17), preferably 15635 to 15644 or 15645 to 15659, more preferably 15635 to 15644 (first oligonucleotide); or 15724 to 15738 (derived from SEQ ID NO: 198) or 15739 to 15759 (derived from SEQ ID NO: 199), more preferably 15724 to 15738 (second oligonucleotide), or iii. wherein all cytosine bases of said first and/or second oligonucleotide are 5-methylcytosine and all uracil bases of said first and/or second oligonucleotide are 5-methyluracil, as represented by SEQ ID NO: 15786 to 15795 (derived from SEQ ID NO: 14), 15796 to 15810 (derived from SEQ ID NO: 15), 15811 to 15825 (derived from SEQ ID NO: 16) or 15826 to 15861 (derived from SEQ ID NO: 17), preferably 15786 to 15795 or 15796 to 15810, more preferably 15786 to 15795 (first oligonucleotide); or 15875 to 15889 (derived from SEQ ID NO: 198) or 15890 to 15910 (derived from SEQ ID NO: 199), more preferably 15875 to 15889 (second oligonucleotide).

In an even more preferred embodiment, when said first oligonucleotide of the compound of the invention is represented by a nucleotide sequence comprising or consisting of a sequence represented by SEQ ID NO: 14, 15, 16, 17 or 18, or a fragment thereof as earlier defined herein, one or more monomers of said nucleotide sequence comprise a BNA scaffold modification, a bridged nucleic acid scaffold modification, more preferably a LNA modification, as follows (see Tables 1 and 2):

(i) when represented by SEQ ID NO: 14:
   any one of SEQ ID NO: 15911 to 15922, wherein preferably:
     all cytosine bases are 5-methylcytosine as represented by any of SEQ ID NO: 15977 to 15988, or
     all uracil bases are 5-methyluracil as represented by any one of SEQ ID NO: 16043 to 16054, or
     all cytosine bases are 5-methylcytosine and all uracil bases are 5-methyluracil as represented by any one of SEQ ID NO: 16109 to 16120, or
     more preferably, wherein all cytosine bases are 5-methylated as represented by any one of SEQ ID NO: 15977 to 15988;
(ii) when represented by SEQ ID NO: 15:
   SEQ ID NO: 15923 or 15924, wherein preferably:
     all cytosine bases are 5-methylcytosine as represented by SEQ ID NO: 15989 or 15990, or
     all uracil bases are 5-methyluracil as represented by SEQ ID NO: 16055 or 16056, or
     all cytosine bases are 5-methylcytosine and all uracil bases are 5-methyluracil as represented by SEQ ID NO: 16121 or 16122, or
     more preferably, wherein all cytosine bases are 5-methylated as represented by SEQ ID NO: 15989 or 15990;
(iii) when represented by SEQ ID NO: 16:
   any one of SEQ ID NO: 15925 to 15934, wherein preferably:
     all cytosine bases are 5-methylcytosine as represented by any of SEQ ID NO: 15991 to 16000, or
     all uracil bases are 5-methyluracil as represented by any one of SEQ ID NO: 16057 to 16066, or
     all cytosine bases are 5-methylcytosine and all uracil bases are 5-methyluracil as represented by any one of SEQ ID NO: 16123 to 16132, or
     more preferably, wherein all cytosine bases are 5-methylated as represented by any one of SEQ ID NO: 15991 to 16000;
(iv) when represented by SEQ ID NO: 17:
   any one of SEQ ID NO: 15935 to 15945, wherein preferably:
     all cytosine bases are 5-methylcytosine as represented by any of SEQ ID NO: 16001 to 16011, or
     all uracil bases are 5-methyluracil as represented by any one of SEQ ID NO: 16067 to 16077, or
     all cytosine bases are 5-methylcytosine and all uracil bases are 5-methyluracil as represented by any one of SEQ ID NO: 16133 to 16143, or
     more preferably, wherein all cytosine bases are 5-methylated as represented by any one of SEQ ID NO: 16001 to 16011;
(v) when represented by SEQ ID NO: 18:
   SEQ ID NO: 15946 or 15947, wherein preferably:
     all cytosine bases are 5-methylcytosine as represented by SEQ ID NO: 16012 or 16013, or
     all uracil bases are 5-methyluracil as represented by SEQ ID NO: 16078 or 16079, or
     all cytosine bases are 5-methylcytosine and all uracil bases are 5-methyluracil as represented by SEQ ID NO: 16144 or 16145;
     more preferably, wherein all cytosine bases are 5-methylated as represented by any one of SEQ ID NO: 16012 or 16013;
and/or when said second oligonucleotide of the compound of the invention is represented by a nucleotide sequence comprising or consisting of a sequence represented by SEQ ID NO: 198, 199, 200 or 201, or a fragment thereof as earlier defined herein, one ore more monomers of said nucleotide sequence comprise a BNA scaffold modification, a bridged nucleic acid scaffold modification, more preferably a LNA modification, as follows:
(i) when represented by SEQ ID NO: 198:
   any one of SEQ ID NO: 15948 to 15962, wherein preferably:
     all cytosine bases are 5-methylcytosine as represented by any of SEQ ID NO: 16014 to 16028, or
     all uracil bases are 5-methyluracil as represented by any one of SEQ ID NO: 16080 to 16094, or
     all cytosine bases are 5-methylcytosine and all uracil bases are 5-methyluracil as represented by any one of SEQ ID NO: 16146 to 16160;
     more preferably, wherein all cytosine bases are 5-methylated as represented by any one of SEQ ID NO: 16014 to 16028;
(ii) when represented by SEQ ID NO: 199:
   any one of SEQ ID NO: 15963 to 15972, wherein preferably:
     all cytosine bases are 5-methylcytosine as represented by any of SEQ ID NO: 16029 to 16038, or
     all uracil bases are 5-methyluracil as represented by any one of SEQ ID NO: 16095 to 16104, or
     all cytosine bases are 5-methylcytosine and all uracil bases are 5-methyluracil as represented by any one of SEQ ID NO: 16161 to 16170;
     more preferably, wherein all cytosine bases are 5-methylated as represented by any one of SEQ ID NO: 16029 to 16038;
(iii) when represented by SEQ ID NO: 200:
   any one of SEQ ID NO: 15973 to 15975, wherein preferably:
     all cytosine bases are 5-methylcytosine as represented by any of SEQ ID NO: 16039 to 16041, or
     all uracil bases are 5-methyluracil as represented by any one of SEQ ID NO: 16105 to 16107, or
     all cytosine bases are 5-methylcytosine and all uracil bases are 5-methyluracil as represented by any one of SEQ ID NO: 16171 to 16173;
     more preferably, wherein all cytosine bases are 5-methylated as represented by any one of SEQ ID NO: 16039 to 16041;
(iv) when represented by SEQ ID NO: 201:
   SEQ ID NO: 15976, wherein preferably:
     all cytosine bases are 5-methylcytosine as represented by SEQ ID NO: 16042, or
     all uracil bases are 5-methyluracil as represented by SEQ ID NO: 16108, or
     all cytosine bases are 5-methylcytosine and all uracil bases are 5-methyluracil as represented by SEQ ID NO: 16174;
     more preferably, wherein all cytosine and all uracil bases are 5-methylated as represented by SEQ ID NO: 16042.

Preferably said first and second antisense oligonucleotides of the compound of the invention are distinct, more preferably the nucleotide sequence of said first and second antisense oligonucleotide are represented by a distinct SEQ ID NO.

Said first and/or second oligonucleotide of the compound preferably comprises at least one 2'-O-substituted RNA monomer and optionally a phosphorothioate backbone linkage, more preferably comprises or consists of 2'-O-substituted RNA monomers linked by phosphorothioate backbone linkages as defined earlier herein.

As such, in a more preferred embodiment, the invention as such provides a compound, preferably for skipping exon 51, comprising or consisting of a first and a second antisense oligonucleotide linked to each other by a linking moiety, wherein said first antisense oligonucleotide is represented by a nucleotide sequence comprising or consisting of any one of:
  i) SEQ ID NO: 15911 to 15922, preferably 15977 to 15988 (derived from SEQ ID NO: 14), SEQ ID NO: 15923 or 15924, preferably 15989 or 15990 (derived from SEQ ID NO: 15), SEQ ID NO: 15925 to 15934, preferably 15991 to 16000 (derived from SEQ ID NO: 16), SEQ ID NO: 15935 to 15945, preferably 16001 to 16011 (derived from SEQ ID NO: 17), or 15946 or 15947, preferably 16012 or 16013 (derived from SEQ ID NO: 18), or
  ii) a fragment of any one of SEQ ID NO: 15911 to 15922, preferably 15977 to 15988 (derived from SEQ ID NO: 14), SEQ ID NO: 15923 or 15924, preferably 15989 or 15990 (derived from SEQ ID NO: 15), SEQ ID NO: 15925 to 15934, preferably 15991 to 16000 (derived from SEQ ID NO: 16), SEQ ID NO: 15935 to 15945, preferably 16001 to 16011 (derived from SEQ ID NO: 17), or 15946 or 15947, preferably 16012 or 16013 (derived from SEQ ID NO: 18), or
  iii) SEQ ID NO: 15911 to 15922, preferably 15977 to 15988 (derived from SEQ ID NO: 14), SEQ ID NO: 15923 or 15924, preferably 15989 or 15990 (derived from SEQ ID NO: 15), SEQ ID NO: 15925 to 15934, preferably 15991 to 16000 (derived from SEQ ID NO: 16), SEQ ID NO: 15935 to 15945, preferably 16001 to 16011 (derived from SEQ ID NO: 17), or 15946 or 15947, preferably 16012 or 16013 (derived from SEQ ID NO: 18), with 1, 2, 3, 4, or 5 additional nucleotides, or
  iv) SEQ ID NO: 15911 to 15922, preferably 15977 to 15988 (derived from SEQ ID NO: 14), SEQ ID NO: 15923 or 15924, preferably 15989 or 15990 (derived from SEQ ID NO: 15), SEQ ID NO: 15925 to 15934, preferably 15991 to 16000 (derived from SEQ ID NO: 16), SEQ ID NO: 15935 to 15945, preferably 16001 to 16011 (derived from SEQ ID NO: 17), or 15946 or 15947, preferably 16012 or 16013 (derived from SEQ ID NO: 18), with 1, 2, 3, 4, or 5 nucleotides missing from said SEQ ID NO, or
  v) a nucleotide sequence which has at least 90%, 91%, 92%, 93%, 94%, 95%, 96%, 97%, 98% or 99%, preferably at least 95%, more preferably at least 97%, identity with any one of SEQ ID NO: 15911 to 15922, preferably 15977 to 15988 (derived from SEQ ID NO: 14), SEQ ID NO: 15923 or 15924, preferably 15989 or 15990 (derived from SEQ ID NO: 15), SEQ ID NO: 15925 to 15934, preferably 15991 to 16000 (derived from SEQ ID NO: 16), SEQ ID NO: 15935 to 15945, preferably 16001 to 16011 (derived from SEQ ID NO: 17), or 15946 or 15947, preferably 16012 or 16013 (derived from SEQ ID NO: 18);

and/or wherein said second antisense oligonucleotide is represented by a nucleotide sequence comprising or consisting of any one of:
  i) SEQ ID NO: 15948 to 15962, preferably 16014 to 16028 (derived from SEQ ID NO: 198), SEQ ID NO: 15963 to 15972, preferably 16029 to 16038 (derived from SEQ ID NO: 199), SEQ ID NO: 15973 to 15975, preferably 16039 to 16107 (derived from SEQ ID NO: 200), or SEQ ID NO: 15976, preferably 16042 (derived from SEQ ID NO: 201), or
  ii) a fragment of any one of SEQ ID NO: 15948 to 15962, preferably 16014 to 16028 (derived from SEQ ID NO: 198), SEQ ID NO: 15963 to 15972, preferably 16029 to 16038 (derived from SEQ ID NO: 199), SEQ ID NO: 15973 to 15975, preferably 16039 to 16107 (derived from SEQ ID NO: 200), or SEQ ID NO: 15976, preferably 16042 (derived from SEQ ID NO: 201), or
  iii) SEQ ID NO: 15948 to 15962, preferably 16014 to 16028 (derived from SEQ ID NO: 198), SEQ ID NO: 15963 to 15972, preferably 16029 to 16038 (derived from SEQ ID NO: 199), SEQ ID NO: 15973 to 15975, preferably 16039 to 16107 (derived from SEQ ID NO: 200), or SEQ ID NO: 15976, preferably 16042 (derived from SEQ ID NO: 201), with 1, 2, 3, 4, or 5 additional nucleotides, or
  iv) SEQ ID NO: 15948 to 15962, preferably 16014 to 16028 (derived from SEQ ID NO: 198), SEQ ID NO: 15963 to 15972, preferably 16029 to 16038 (derived from SEQ ID NO: 199), SEQ ID NO: 15973 to 15975, preferably 16039 to 16107 (derived from SEQ ID NO: 200), or SEQ ID NO: 15976, preferably 16042 (derived from SEQ ID NO: 201), with 1, 2, 3, 4, or 5 nucleotides missing from said SEQ ID NO, or
  v) a nucleotide sequence which has at least 90%, 91%, 92%, 93%, 94%, 95%, 96%, 97%, 98% or 99%, preferably at least 95%, more preferably at least 97%, identity with any one of SEQ ID NO: 15948 to 15962, preferably 16014 to 16028 (derived from SEQ ID NO: 198), SEQ ID NO: 15963 to 15972, preferably 16029 to 16038 (derived from SEQ ID NO: 199), SEQ ID NO: 15973 to 15975, preferably 16039 to 16107 (derived from SEQ ID NO: 200), or SEQ ID NO: 15976, preferably 16042 (derived from SEQ ID NO: 201), wherein said first antisense oligonucleotide is complementary to or binds to or targets or hybridizes to or overlaps with at least a part of SEQ ID NO: 3, and wherein said second antisense oligonucleotide is complementary to or binds to or targets or hybridizes to or overlaps with at least a part of SEQ ID NO: 4, wherein said SEQ ID NO: 3 and 4 are located within exon 51 of dystrophin pre-mRNA.

Preferably said first and second antisense oligonucleotides of the compound of the invention are distinct, more preferably the nucleotide sequence of said first and second antisense oligonucleotide are represented by a distinct SEQ ID NO.

Said "1, 2, 3, 4 or 5 additional nucleotides" may be present at the 5' and/or 3' side of a given SEQ ID NO.

Said "1, 2, 3, 4 or 5 missing nucleotides" may be nucleotides missing at the 5' and/or 3' side of a given SEQ ID NO.

Also in this context it is allowed to have 1 or 2 mismatch(es) in an oligonucleotide of 20 nucleotides or 1 to 4 mismatches in an oligonucleotide of 40 nucleotides. In an oligonucleotide of 10 to 33 nucleotides, 0, 1, 2 or 3 mismatches are present, preferably, 0, 1 or 2 mismatches are present, as defined earlier herein. In an oligonucleotide of 16 to 22 nucleotides, we may have 0, 1, 2 mismatches present, preferably 0 or 1 mismatch is present.

Said first and/or second oligonucleotide of the compound preferably comprises at least one 2'-O-substituted RNA monomer and optionally a phosphorothioate backbone linkage, more preferably comprises or consists of 2'-O-substituted RNA monomers linked by phosphorothioate backbone linkages as defined earlier herein.

TABLE 1

Preferred BNA-modified sequences of first and/or second antisense oligonucleotide of the compound

| | | BNA-modified sequence (underlined nucleotides comprise BNA, preferably LNA) | Derived from unmodified sequence |
|---|---|---|---|
| Exon 51 | ESE 1 (SEQ ID NO: 3) | GGUAAGUUCUGUCCAAGC (SEQ ID NO: 15911) | SEQ ID NO: 14 |
| | | GGUAAGUUCUGUCCAAGC (SEQ ID NO: 15912) | SEQ ID NO: 14 |
| | | GGUAAGUUCUGUCCAAGC (SEQ ID NO: 15913) | SEQ ID NO: 14 |
| | | GGUAAGUUCUGUCCAAGC (SEQ ID NO: 15914) | SEQ ID NO: 14 |
| | | GGUAAGUUCUGUCCAAGC (SEQ ID NO: 15915) | SEQ ID NO: 14 |
| | | GGUAAGUUCUGUCCAAGC (SEQ ID NO: 15916) | SEQ ID NO: 14 |
| | | GGUAAGUUCUGUCCAAGC (SEQ ID NO: 15917) | SEQ ID NO: 14 |
| | | GGUAAGUUCUGUCCAAGC (SEQ ID NO: 15918) | SEQ ID NO: 14 |
| | | GGUAAGUUCUGUCCAAGC (SEQ ID NO: 15919) | SEQ ID NO: 14 |
| | | GGUAAGUUCUGUCCAAGC (SEQ ID NO: 15920) | SEQ ID NO: 14 |
| | | GGUAAGUUCUGUCCAAGC (SEQ ID NO: 15921) | SEQ ID NO: 14 |
| | | GGUAAGUUCUGUCCAAGC (SEQ ID NO: 15922) | SEQ ID NO: 14 |
| | | GUAAGUUCUGUCCAAGCC (SEQ ID NO: 15923) | SEQ ID NO: 15 |
| | | GUAAGUUCUGUCCAAGCC (SEQ ID NO: 15924) | SEQ ID NO: 15 |
| | | AGUCGGUAAGUUCUGUCC (SEQ ID NO: 15925) | SEQ ID NO: 16 |
| | | AGUCGGUAAGUUCUGUCC (SEQ ID NO: 15926) | SEQ ID NO: 16 |
| | | AGUCGGUAAGUUCUGUCC (SEQ ID NO: 15927) | SEQ ID NO: 16 |
| | | AGUCGGUAAGUUCUGUCC (SEQ ID NO: 15928) | SEQ ID NO: 16 |
| | | AGUCGGUAAGUUCUGUCC (SEQ ID NO: 15929) | SEQ ID NO: 16 |
| | | AGUCGGUAAGUUCUGUCC (SEQ ID NO: 15930) | SEQ ID NO: 16 |
| | | AGUCGGUAAGUUCUGUCC (SEQ ID NO: 15931) | SEQ ID NO: 16 |
| | | AGUCGGUAAGUUCUGUCC (SEQ ID NO: 15932) | SEQ ID NO: 16 |
| | | AGUCGGUAAGUUCUGUCC (SEQ ID NO: 15933) | SEQ ID NO: 16 |
| | | AGUCGGUAAGUUCUGUCC (SEQ ID NO: 15934) | SEQ ID NO: 16 |
| | | CUGUCCAAGCCCGGUUGA (SEQ ID NO: 15935) | SEQ ID NO: 17 |
| | | CUGUCCAAGCCCGGUUGA (SEQ ID NO: 15936) | SEQ ID NO: 17 |
| | | CUGUCCAAGCCCGGUUGA (SEQ ID NO: 15937) | SEQ ID NO: 17 |
| | | CUGUCCAAGCCCGGUUGA (SEQ ID NO: 15938) | SEQ ID NO: 17 |
| | | CUGUCCAAGCCCGGUUGA (SEQ ID NO: 15939) | SEQ ID NO: 17 |
| | | CUGUCCAAGCCCGGUUGA (SEQ ID NO: 15940) | SEQ ID NO: 17 |
| | | CUGUCCAAGCCCGGUUGA (SEQ ID NO: 15941) | SEQ ID NO: 17 |
| | | CUGUCCAAGCCCGGUUGA (SEQ ID NO: 15942) | SEQ ID NO: 17 |
| | | CUGUCCAAGCCCGGUUGA (SEQ ID NO: 15943) | SEQ ID NO: 17 |
| | | CUGUCCAAGCCCGGUUGA (SEQ ID NO: 15944) | SEQ ID NO: 17 |
| | | CUGUCCAAGCCCGGUUGA (SEQ ID NO: 15945) | SEQ ID NO: 17 |
| | | TAAGUUCUGUCCAAG (SEQ ID NO: 15946) | SEQ ID NO: 18 |
| | | TAAGUUCUGUCCAAG (SEQ ID NO: 15947) | SEQ ID NO: 18 |
| | ESE 2 (SEQ ID NO: 4) | TCAAGGAAGAUGGCAUUUCU (SEQ ID NO: 15948) | SEQ ID NO: 198 |
| | | UCAAGGAAGAUGGCAUUUCU (SEQ ID NO: 15949) | SEQ ID NO: 198 |
| | | TCAAGGAAGAUGGCAUUUCU (SEQ ID NO: 15950) | SEQ ID NO: 198 |
| | | TCAAGGAAGAUGGCAUUUCU (SEQ ID NO: 15951) | SEQ ID NO: 198 |
| | | TCAAGGAAGAUGGCAUUUCU (SEQ ID NO: 15952) | SEQ ID NO: 198 |
| | | TCAAGGAAGAUGGCAUUUCT (SEQ ID NO: 15953) | SEQ ID NO: 198 |
| | | TCAAGGAAGAUGGCAUUUCT (SEQ ID NO: 15954) | SEQ ID NO: 198 |
| | | TCAAGGAAGAUGGCAUUUCT (SEQ ID NO: 15955) | SEQ ID NO: 198 |
| | | TCAAGGAAGAUGGCAUUUCT (SEQ ID NO: 15956) | SEQ ID NO: 198 |
| | | TCAAGGAAGATGGCAUUUCT (SEQ ID NO: 15957) | SEQ ID NO: 198 |
| | | TCAAGGAAGAUGGCAUUUCT (SEQ ID NO: 15958) | SEQ ID NO: 198 |
| | | TCAAGGAAGAUGGCAUUUCT (SEQ ID NO: 15959) | SEQ ID NO: 198 |
| | | TCAAGGAAGAUGGCAUUUCT (SEQ ID NO: 15960) | SEQ ID NO: 198 |
| | | TCAAGGAAGAUGGCAUUUCT (SEQ ID NO: 15961) | SEQ ID NO: 198 |
| | | TCAAGGAAGAUGGCAUUUCT (SEQ ID NO: 15962) | SEQ ID NO: 198 |
| | | TCAAGGAAGAUGGCAUUUCUAG (SEQ ID NO: 15963) | SEQ ID NO: 199 |
| | | TCAAGGAAGAUGGCAUUUCUAG (SEQ ID NO: 15964) | SEQ ID NO: 199 |
| | | TCAAGGAAGAUGGCAUUUCUAG (SEQ ID NO: 15965) | SEQ ID NO: 199 |
| | | TCAAGGAAGAUGGCAUUUCUAG (SEQ ID NO: 15966) | SEQ ID NO: 199 |
| | | TCAAGGAAGAUGGCAUUUCUAG (SEQ ID NO: 15967) | SEQ ID NO: 199 |
| | | TCAAGGAAGAUGGCAUUUCUAG (SEQ ID NO: 15968) | SEQ ID NO: 199 |
| | | TCAAGGAAGAUGGCAUUUCUAG (SEQ ID NO: 15969) | SEQ ID NO: 199 |
| | | TCAAGGAAGAUGGCAUUUCUAG (SEQ ID NO: 15970) | SEQ ID NO: 199 |
| | | TCAAGGAAGAUGGCAUUUCUAG (SEQ ID NO: 15971) | SEQ ID NO: 199 |
| | | TCAAGGAAGAUGGCAUUUCUAG (SEQ ID NO: 15972) | SEQ ID NO: 199 |
| | | TCAAGGAAGAUGGCAT (SEQ ID NO: 15973) | SEQ ID NO: 200 |
| | | TCAAGGAAGAUGGCAT (SEQ ID NO: 15974) | SEQ ID NO: 200 |
| | | UCAAGGAAGAUGGCAU (SEQ ID NO: 15975) | SEQ ID NO: 200 |
| | | GAAGAUGGCAUUUCT (SEQ ID NO: 15976) | SEQ ID NO: 201 |

TABLE 2

More preferred BNA-modified sequences of first and/or second antisense oligonucleotide of the compound

| | | BNA-modified sequence (underlined nucleotides comprise BNA, preferably LNA; C* = 5mC; U* = 5mU = T) | Derived from unmodified sequence |
|---|---|---|---|
| Exon 51 | ESE 1 (SEQ ID NO: 3) | GGUAAGUUC*UGUC*C*AAGC* (SEQ ID NO: 15977) | SEQ ID NO: 14 |
| | | GGUAAGUUC*TGUC*C*AAGC* (SEQ ID NO: 15978) | SEQ ID NO: 14 |
| | | GGUAAGUUC*UGUC*C*AAGC* (SEQ ID NO: 15979) | SEQ ID NO: 14 |
| | | GGUAAGUUC*UGUC*C*AAGC* (SEQ ID NO: 15980) | SEQ ID NO: 14 |
| | | GGUAAGUUC*UGUC*C*AAGC* (SEQ ID NO: 15981) | SEQ ID NO: 14 |
| | | GGUAAGUUC*UGUC*C*AAGC* (SEQ ID NO: 15982) | SEQ ID NO: 14 |
| | | GGUAAGUUC*UGUC*C*AAGC* (SEQ ID NO: 15983) | SEQ ID NO: 14 |
| | | GGUAAGUUC*UGUC*C*AAGC* (SEQ ID NO: 15984) | SEQ ID NO: 14 |
| | | GGUAAGUUC*UGUC*C*AAGC* (SEQ ID NO: 15985) | SEQ ID NO: 14 |
| | | GGUAAGUUC*UGUC*C*AAGC* (SEQ ID NO: 15986) | SEQ ID NO: 14 |
| | | GGUAAGUUC*UGUC*C*AAGC* (SEQ ID NO: 15987) | SEQ ID NO: 14 |
| | | GGUAAGUUC*UGUC*C*AAGC* (SEQ ID NO: 15988) | SEQ ID NO: 14 |
| | | GUAAGUUC*UGUC*C*AAGC*C* (SEQ ID NO: 15989) | SEQ ID NO: 15 |
| | | GUAAGUUC*UGUC*C*AAGC*C* (SEQ ID NO: 15990) | SEQ ID NO: 15 |
| | | AGUC*GGUAAGUUC*UGUC*C* (SEQ ID NO: 15991) | SEQ ID NO: 16 |
| | | AGUC*GGUAAGUUC*UGUC*C* (SEQ ID NO: 15992) | SEQ ID NO: 16 |
| | | AGUC*GGUAAGUUC*UGUC*C* (SEQ ID NO: 15993) | SEQ ID NO: 16 |
| | | AGUC*GGUAAGUUC*UGUC*C* (SEQ ID NO: 15994) | SEQ ID NO: 16 |
| | | AGUC*GGUAAGUUC*UGUC*C* (SEQ ID NO: 15995) | SEQ ID NO: 16 |
| | | AGUC*GGUAAGUUC*UGUC*C* (SEQ ID NO: 15996) | SEQ ID NO: 16 |
| | | AGUC*GGUAAGUUC*UGUC*C* (SEQ ID NO: 15997) | SEQ ID NO: 16 |
| | | AGUC*GGUAAGUUC*UGUC*C* (SEQ ID NO: 15998) | SEQ ID NO: 16 |
| | | AGUC*GGUAAGUUC*UGUC*C* (SEQ ID NO: 15999) | SEQ ID NO: 16 |
| | | AGUC*GGUAAGUUC*UGUC*C* (SEQ ID NO: 16000) | SEQ ID NO: 16 |
| | | C*UGUC*C*AAGC*C*C*GGUUGA (SEQ ID NO: 16001) | SEQ ID NO: 17 |
| | | C*UGUC*C*AAGC*C*C*GGUUGA (SEQ ID NO: 16002) | SEQ ID NO: 17 |
| | | C*UGUC*C*AAGC*C*C*GGUUGA (SEQ ID NO: 16003) | SEQ ID NO: 17 |
| | | C*UGUC*C*AAGC*C*C*GGUUGA (SEQ ID NO: 16004) | SEQ ID NO: 17 |
| | | C*UGUC*C*AAGC*C*C*GGUUGA (SEQ ID NO: 16005) | SEQ ID NO: 17 |
| | | C*UGUC*C*AAGC*C*C*GGUUGA (SEQ ID NO: 16006) | SEQ ID NO: 17 |
| | | C*UGUC*C*AAGC*C*C*GGUUGA (SEQ ID NO: 16007) | SEQ ID NO: 17 |
| | | C*UGUC*C*AAGC*C*C*GGUUGA (SEQ ID NO: 16008) | SEQ ID NO: 17 |
| | | C*UGUC*C*AAGC*C*C*GGUUGA (SEQ ID NO: 16009) | SEQ ID NO: 17 |
| | | C*UGUC*C*AAGC*C*C*GGUUGA (SEQ ID NO: 16010) | SEQ ID NO: 17 |
| | | C*UGUC*C*AAGC*C*C*GGUUGA (SEQ ID NO: 16011) | SEQ ID NO: 17 |
| | | TAAGUUC*UGUC*C*AAG (SEQ ID NO: 16012) | SEQ ID NO: 18 |
| | | TAAGUUC*UGUC*C*AAG (SEQ ID NO: 16013) | SEQ ID NO: 18 |
| | ESE 2 (SEQ ID NO: 4) | TC*AAGGAAGAUGGC*AUUUC*U (SEQ ID NO: 16014) | SEQ ID NO: 198 |
| | | UC*AAGGAAGAUGGC*AUUUC*U (SEQ ID NO: 16015) | SEQ ID NO: 198 |
| | | TC*AAGGAAGAUGGC*AUUUC*T (SEQ ID NO: 16016) | SEQ ID NO: 198 |
| | | TC*AAGGAAGAUGGC*AUUUC*U (SEQ ID NO: 16017) | SEQ ID NO: 198 |
| | | TC*AAGGAAGAUGGC*AUUUC*U (SEQ ID NO: 16018) | SEQ ID NO: 198 |
| | | TC*AAGGAAGAUGGC*AUUUC*T (SEQ ID NO: 16019) | SEQ ID NO: 198 |
| | | TC*AAGGAAGAUGGC*AUUUC*T (SEQ ID NO: 16020) | SEQ ID NO: 198 |
| | | TC*AAGGAAGAUGGC*AUUUC*T (SEQ ID NO: 16021) | SEQ ID NO: 198 |
| | | TC*AAGGAAGAUGGC*AUUUC*T (SEQ ID NO: 16022) | SEQ ID NO: 198 |
| | | TC*AAGGAAGATGGC*AUUUC*T (SEQ ID NO: 16023) | SEQ ID NO: 198 |
| | | TC*AAGGAAGAUGGC*AUUUC*T (SEQ ID NO: 16024) | SEQ ID NO: 198 |
| | | TC*AAGGAAGAUGGC*AUUUC*T (SEQ ID NO: 16025) | SEQ ID NO: 198 |
| | | TC*AAGGAAGAUGGC*AUUUC*T (SEQ ID NO: 16026) | SEQ ID NO: 198 |
| | | TC*AAGGAAGAUGGC*AUUUC*T (SEQ ID NO: 16027) | SEQ ID NO: 198 |
| | | TC*AAGGAAGAUGGC*AUUUC*T (SEQ ID NO: 16028) | SEQ ID NO: 198 |
| | | TC*AAGGAAGAUGGC*AUUUC*UAG (SEQ ID NO: 16029) | SEQ ID NO: 199 |
| | | TC*AAGGAAGAUGGC*AUUUC*UAG (SEQ ID NO: 16030) | SEQ ID NO: 199 |
| | | TC*AAGGAAGAUGGC*AUUUC*UAG (SEQ ID NO: 16031) | SEQ ID NO: 199 |
| | | TC*AAGGAAGAUGGC*AUUUC*UAG (SEQ ID NO: 16032) | SEQ ID NO: 199 |
| | | TC*AAGGAAGAUGGC*AUUUC*UAG (SEQ ID NO: 16033) | SEQ ID NO: 199 |
| | | TC*AAGGAAGAUGGC*AUUUC*UAG (SEQ ID NO: 16034) | SEQ ID NO: 199 |
| | | TC*AAGGAAGAUGGC*AUUUC*UAG (SEQ ID NO: 16035) | SEQ ID NO: 199 |
| | | TC*AAGGAAGAUGGC*AUUUC*UAG (SEQ ID NO: 16036) | SEQ ID NO: 199 |
| | | TC*AAGGAAGAUGGC*AUUUC*UAG (SEQ ID NO: 16037) | SEQ ID NO: 199 |
| | | TC*AAGGAAGAUGGC*AUUUC*UAG (SEQ ID NO: 16038) | SEQ ID NO: 199 |
| | | TC*AAGGAAGAUGGC*AT (SEQ ID NO: 16039) | SEQ ID NO: 200 |
| | | TC*AAGGAAGAUGGC*AT (SEQ ID NO: 16040) | SEQ ID NO: 200 |
| | | TC*AAGGAAGAUGGC*AU (SEQ ID NO: 16041) | SEQ ID NO: 200 |
| | | GAAGAUGGC*AUUUC*T (SEQ ID NO: 16042) | SEQ ID NO: 201 |

As such, in a more preferred embodiment, a compound of the invention is preferably for skipping exon 51 of the pre-mRNA of dystrophin, and comprises or consists of a first antisense oligonucleotide represented by a nucleotide sequence comprising or consisting of SEQ ID NO: 15980, 16145 or 16144, more preferably SEQ ID NO: 15980, and a second antisense oligonucleotide represented by a nucleotide sequence comprising or consisting of SEQ ID NO: 16026, 16174, 16172 or 16171, more preferably SEQ ID NO: 16026, wherein said first and second antisense oligonucleotide are linked to each other by a linking moiety (as described in the section entitled "Linking moiety"), preferably said linking moiety is tri-ethylene glycol (TEG) or hexa-ethylene glycol (HEG).

Said SEQ ID NO: 15980 is represented by the sequence GGUAAGUUC*UGUC*C*AAGC*, said SEQ ID NO: 16145 is represented by the sequence TAAGTTC*TGTC*C*AAG, said SEQ ID NO: 16144 is represented by the sequence TAAGTTC*TGTC*C*AAG, said SEQ ID NO: 16026 is represented by the sequence TC*AAGGAAGAUGGC*AUUUC*T, said SEQ ID NO: 16174 is represented by the sequence GAAGATGGC*ATTTC*T, said SEQ ID NO: 16172 is represented by the sequence TC*AAGGAAGATGGC*AT and said SEQ ID NO: 16171 is represented by the sequence TC*AAGGAAGATGGC*AT, wherein C* is 5-methylcytosine and T is 5-methyluracil.

In the context of the invention, the positions of said first and second antisense oligonucleotides within the compound of the invention are interchangeable. As such, a preferred compound of the invention can be represented by:
 i) SEQ ID NO: 16335-TEG-SEQ ID NO: 16514 (GGUAAGUUC*UGUC*C*AAGC*n TC*AAGGAAGAUGGC*AUUUC*T) or SEQ ID NO: 16336-TEG-SEQ ID NO: 16515 (TC*AAGGAAGAUGGC*AUUUC*TnGGUAAGU UC*UGUC*C*AAGC*), wherein the linking moiety, represented by n, is a TEG linker, or
 ii) SEQ ID NO: 16337-HEG-SEQ ID NO: 16516 (GGUAAGUUC*UGUC*C*AAGC*nTC*AAGGAA GAUGGC*AUUUC*T) or SEQ ID NO: 16338-HEG-SEQ ID NO: 16517 (TC*AAGGAAGAUGGC*AUUUC*TnGGUAAGU UC*UGUC*C*AAGC*), wherein the linking moiety, represented by n, is a HEG linker, or
 iii) SEQ ID NO: 16339-TEG-SEQ ID NO: 16518 (TAAGTTC*TGTC*C*AAGnGAAGATGGC*ATTT C*T) or SEQ ID NO: 16340-TEG-SEQ ID NO: 16519 (GAAGATGGC*ATTTC*TnTAAGTTC*TGTC*C* AAG), wherein the linking moiety, represented by n, is a TEG linker, or
 iv) SEQ ID NO: 16341-HEG-SEQ ID NO: 16520 (TAAGTTC*TGTC*C*AAGnGAAGATGGC*ATTT C*T) or SEQ ID NO: 16342-HEG-SEQ ID NO: 16521 (GAAGATGGC*ATTTC*TnTAAGTTC*TGTC*C*A AG), wherein the linking moiety, represented by n, is a HEG linker, or
 v) SEQ ID NO: 16343-TEG-SEQ ID NO: 16522 (TAAGTTC*TGTC*C*AAGnTC*AAGGAAGATGG C*AT) or SEQ ID NO: 16344-TEG-SEQ ID NO: 16523 (TC*AAGGAAGATGGC*ATnTAAGTTC* TGTC*C*AAG), wherein the linking moiety, represented by n, is a TEG linker, or
 vi) SEQ ID NO: 16345-HEG-SEQ ID NO: 16524 (TAAGTTC*TGTC*C*AAGnTC*AAGGAAGATGG C*AT) or SEQ ID NO: 16346-HEG-SEQ ID NO: 16525 (TC*AAGGAAGATGGC*ATnTAAGTTC*TGTC*C* AAG), wherein the linking moiety, represented by n, is a HEG linker, or
 vii) SEQ ID NO: 16347-TEG-SEQ ID NO: 16526 (TAAGTTC*TGTC*C*AAGnTC*AAGGAAGATGG C*AT) or SEQ ID NO: 16348-TEG-SEQ ID NO: 16527 (TC*AAGGAAGATGGC*ATnTAAGTTC*TGTC*C* AAG), wherein the linking moiety, represented by n, is a TEG linker, or
 viii) SEQ ID NO: 16349-HEG-SEQ ID NO: 16528 (TAAGTTC*TGTC*C*AAGnTC*AAGGAAGATGG C*AT) or SEQ ID NO: 16350-HEG-SEQ ID NO: 16529 (TC*AAGGAAGATGGC*ATnTAAGTTC*TGTC*C* AAG), wherein the linking moiety, represented by n, is a HEG linker.

An even more preferred compound of the invention is represented by SEQ ID NO: 16335-TEG-16514 or 16336-TEG-16515 (TEG linker) or SEQ ID NO: 16337-HEG-16516 or 16338-HEG-16517 (HEG linker).

In preferred embodiments the compound of the invention is one wherein said compound has an improved parameter by comparison to a corresponding mixture of said first and second antisense oligonucleotide as linked in said compound (in the compound said first and second antisense oligonucleotides are linked to each other by a linking moiety, whereas in the mixture said first and second antisense oligonucleotides are not linked to each other), preferably wherein the concentration of said first and second antisense oligonucleotide in the mixture is the same as in the compound of the invention. In other preferred embodiments the compound of the invention is one wherein said compound has an improved parameter by comparison to Drisapersen (SEQ ID NO: 7, i.e. UCAAGGAAGAUGGCAUUUCU, wherein each RNA monomer is 2-O-methylated and wherein the whole backbone is phosphorothioate) and/or Eteplirsen (SEQ ID NO: 8, i.e. CTCCAACATCAAGGAAGATGG-CATTTCTAG, wherein each monomer is modified as to form a phosphorodiamidate morpholino oligomer).

In this context, parameters may include: binding affinity and/or kinetics, exon skipping activity, biostability, (intra-tissue) distribution, cellular uptake and/or trafficking, and/or immunogenicity. Preferably said improved parameter is increased exon skipping activity.

Exon skipping activity is preferably measured by analysing total RNA isolated from compound/mixture-treated muscle cell cultures or muscle tissue by reverse transcriptase quantitative or digital droplet polymerase chain reaction (RT-qPCR or RT-ddPCR) using DMD gene-specific primers flanking the targeted exon as described (Spitali et al., 2013, Verheul et al., 2016). The ratio of shorter transcript fragments, representing transcripts in which the targeted exon is skipped, to the total of transcript products is assessed (calculated as percentage of exon skipping induced by an oligonucleotide). Shorter fragments may also be sequenced to determine the correctness and specificity of the targeted exon to be skipped.

In certain embodiments, RNA modulation activity may be an increase or decrease in an amount of a nucleic acid or protein. In certain embodiments, such activity may be a change in the ratio of splice variants of a nucleic acid or protein. Detection and/or measuring of antisense activity may be direct or indirect. In certain embodiments, antisense activity is assessed by observing a phenotypic change in a cell or animal.

As used herein and explained above, "modulation" can refer to a perturbation of amount or quality of a function or activity when compared to the function or activity prior to modulation. For example, modulation includes the change, either an increase (stimulation or induction) or a decrease (inhibition or reduction) in dystrophin mRNA or protein as defined earlier herein. As a further example, modulation of expression can include perturbing splice site selection of pre-mRNA processing, resulting in a change in the amount of a particular splice-variant present compared to conditions that were not perturbed.

Biodistribution and biostability are preferably at least in part determined by a validated sandwich hybridization assay adapted from Straarup et al., 2010. In an embodiment, plasma or homogenized tissue samples are incubated with a specific capture oligonucleotide probe complementary to part of the AON analyte. After separation, a DIG-labeled oligonucleotide probe is hybridized to the other part of the AON analyte, and quantitative detection follows using an anti-DIG antibody-linked peroxidase. Plasma oligonucleotide concentrations (μg/mL) are monitored over time to assess the peak concentration ($C_{max}$), time to peak concentration ($T_{max}$), area under the curve (AUC) and half-life. End of study tissue sample concentrations (μg/g tissue) are measured to assess tissue distribution. Non-compartmental pharmacokinetic analysis is performed using the Phoenix software package (WinNonlin module, version 6.4, Pharsight, Mountainview, CA).

Accordingly, a preferred compound of the invention has an improved parameter, such as an acceptable or a decreased immunogenicity and/or a better biodistribution and/or acceptable or improved RNA binding kinetics and/or thermodynamic properties by comparison to a corresponding mixture of said first and second antisense oligonucleotide as linked in said compound wherein said mixture differs only from the compound of the invention through omission of a linking moiety (linking both AONs in the compound of the invention). i.e. the first and second antisense oligonucleotides of the mixture have the same sequence and are modified in the same way as the first and second antisense oligonucleotides of the compound of the invention. Each of these parameters could be assessed using assays known to the skilled person or preferably as disclosed herein.

Further Chemical Modifications of the First and/or Second Antisense Oligonucleotide of the Compound It is to be understood in the context of the present invention that an oligonucleotide comprising or consisting of any chemical modification, or any combination thereof, as described in the present paragraph ("Further chemical modifications of the first and/or second antisense oligonucleotide of the compound") has an exon skipping activity that is at least as good as its counterpart without these modification(s) as described in the paragraph "First and second antisense oligonucleotide of the compound" and/or "Chemical modifications of the first and/or second antisense oligonucleotide of the compound" above, preferably said exon skipping activity is higher than said counterpart without these modification(s). As such, a compound of the invention wherein said first and/or second antisense oligonucleotide comprises or consists of any chemical modification, or any combination thereof, as described in the present paragraph ("Further chemical modifications of the first and/or second antisense oligonucleotide of the compound") has an exon skipping activity that is at least as good as said compound without said chemical modification or combination thereof. Preferably, said exon skipping activity is higher than the one of said compound without said chemical modification or combination thereof.

Below other chemistries and modifications of the first and/or second antisense oligonucleotide of the compound of the invention are defined. These additional chemistries and modifications may be present in combination with the chemistry already defined for said first and/or second oligonucleotide, i.e. comprising or consisting of at least one 2'-substituted monomer with optional phosphrothioate backbone linkages, with or without a 5-methylcytosine and/or a 5-methyluracil, and/or the presence of at least 1 BNA scaffold modification.

In addition to these modifications described above, the first and/or second oligonucleotide of the compound of the invention may comprise further modifications such as different types of nucleic acid monomers or nucleotides as described below. Different types of nucleic acid monomers may be used to generate said first and/or second oligonucleotide. Said first and/or second oligonucleotide may have at least one backbone, and/or scaffold modification and/or at least one base modification compared to an RNA-based oligonucleotide.

A base modification can include a modified version of the natural purine and pyrimidine bases (e.g. adenine, uracil, guanine, cytosine, and thymine), such as hypoxanthine, pseudouracil, pseudocytosine, 1-methylpseudouracil, orotic acid, agmatidine, lysidine, 2-thiopyrimidine (e.g. 2-thiouracil, 2-thiothymine), G-clamp and its derivatives, 5-substituted pyrimidine (e.g. 5-halouracil, 5-halomethyluracil, 5-trifluoromethyluracil, 5-propynyluracil, 5-propynylcytosine, 5-aminomethyluracil, 5-hydroxymethyluracil, 5-aminomethylcytosine, 5-hydroxymethylcytosine, Super T, or as described in e.g. Kumar et al. *J. Org. Chem.* 2014, 79, 5047; Leszczynska et al. *Org. Biol. Chem.* 2014, 12, 1052), pyrazolo[1,5-a]-1,3,5-triazine C-nucleoside (as in e.g. Lefoix et al. *J. Org. Chem.* 2014, 79, 3221), 7-deazaguanine, 7-deazaadenine, 7-aza-2,6-diaminopurine, 8-aza-7-deazaguanine, 8-aza-7-deazaadenine, 8-aza-7-deaza-2,6-diaminopurine, Super G, Super A, boronated cytosine (as in e.g. Niziol et al. *Bioorg. Med. Chem.* 2014, 22, 3906), pseudoisocytidine, C(Pyc) (as in e.g. Yamada et al. *Org. Biomol. Chem.* 2014, 12, 2255) and N4-ethylcytosine, or derivatives thereof; $N^2$-cyclopentylguanine (cPent-G), $N^2$-cyclopentyl-2-aminopurine (cPent-AP), and $N^2$-propyl-2-aminopurine (Pr-AP), carbohydrate-modified uracil (as in e.g. Kaura et al. *Org. Lett.* 2014, 16, 3308), amino acid modified uracil (as in e.g. Guenther et al. *Chem. Commun.* 2014, 50, 9007); or derivatives thereof; and degenerate or universal bases, like 2,6-difluorotoluene or absent bases like abasic sites (e.g. 1-deoxyribose, 1,2-dideoxyribose, 1-deoxy-2-O-methylribose; or pyrrolidine derivatives in which the ring oxygen has been replaced with nitrogen (azaribose)). Examples of derivatives of Super A, Super G and Super T can be found in U.S. Pat. No. 6,683,173 (Epoch Biosciences), which is incorporated here entirely by reference. cPent-G, cPent-AP and Pr-AP were shown to reduce immunostimulatory effects when incorporated in siRNA (Peacock H. et al. *J. Am. Chem. Soc.* 2011, 133, 9200). Examples of modified bases are described in e.g. WO2014/093924 (ModeRNA).

Depending on its length said first and or second oligonucleotide of the compound of the invention may comprise or consist of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 34, 35, 36 or 37 base modifications. It is also encompassed by the invention to introduce more than one distinct base modification in said first and/or second oligonucleotide.

In addition to BNA scaffold modifications already described, a scaffold modification can include a modified version of the ribosyl moiety, such as 2'-O-modified RNA such as 2'-O-alkyl or 2'-O-(substituted)alkyl e.g. 2'-O- methyl, 2'-O-(2-cyanoethyl), 2'-O-(2-methoxy)ethyl (2'-MOE), 2'-O-(2-thiomethyl)ethyl, 2'-O-butyryl, 2'-O-propargyl, 2'-O-acetalester (such as e.g. Biscans et al. *Bioorg. Med. Chem.* 2015, 23, 5360), 2'-O-allyl, 2'-O-(25-methoxypropyl), 2'-O—(N-(aminoethyl)carbamoyl)methyl) (2'-AECM), 2'-O-(2-carboxyethyl) and carbamoyl derivatives (Yamada et al. *Org. Biomol. Chem.* 2014, 12, 6457), 2'-O-(2-amino)propyl, 2'-O-(2-(dimethylamino)propyl), 2'-O-(2-amino)ethyl, 2'-O-(2-(dimethylamino)ethyl); 2'-deoxy (DNA); 2'-O-(haloalkoxy)methyl (Arai K. et al. *Bioorg. Med. Chem.* 2011, 21, 6285) e.g. 2'-O-(2-chloroethoxy) methyl (MCEM), 2'-O-(2,2-dichloroethoxy)methyl (DCEM); 2'-O-alkoxycarbonyl e.g. 2'-O-[2-(methoxycarbonyl)ethyl] (MOCE), 2'-O-[2-(N-methylcarbamoyl)ethyl] (MCE), 2'-0-[2-(N,N-dimethylcarbamoyl)ethyl] (DCME), 2'-O-[2-(methylthio)ethyl] (2'-MTE); 2'-(ω-O-serinol); 2'-halo e.g. 2'-F, FANA (2'-Farabinosyl nucleic acid); 2',4'-difluoro-2'-deoxy; carbasugar and azasugar modifications; 3'-O-substituted e.g. 3'-O-methyl, 3'-O-butyryl, 3'-O-propargyl; 4'-substituted e.g. 4'-aminomethyl-2'-O-methyl or 4'-aminomethyl-2'-fluoro; 5'-substituted e.g. 5'-methyl or CNA (Østergaard et al. *ACS Chem. Biol.* 2014, 22, 6227); and their derivatives.

Depending on its length said first and/or second oligonucleotide of the compound of the invention may comprise or consist of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or 36 scaffold modifications additional to the at least 1 BNA scaffold modification. It is also encompassed by the invention to introduce more than one distinct scaffold modification in said first and/or second oligonucleotide.

Other modifications include unlocked nucleic acid (UNA); cyclohexenyl nucleic acid (CeNA), F-CeNA, cyclohexanyl nucleic acid (CNA), ribo-cyclohexanyl nucleic acid (r-CNA), altritol nucleic acid (ANA), hexitol nucleic acid (HNA), fluorinated HNA (F-HNA), pyranosyl-RNA (p-RNA), 3'-deoxypyranosyl-DNA (p-DNA); and their derivatives. Examples of fluorinated nucleic acid analogues with furanose and non-furanose sugar rings are also encompassed and are described in e.g. Østergaard et al. *J. Org. Chem.* 2014, 79, 8877.

Depending on its length said first and/or second oligonucleotide of the compound of the invention may comprise or consist of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36 or 37 scaffold modifications in addition to the at least 1 BNA scaffold modification. In a preferred embodiment, a first and/or second oligonucleotide of the compound of the invention is fully 2'-O-methyl modified and contains 1, 2, 3, 4, 5, 6, 7, 8 or 9 BNA scaffold modifications.

The first and/or second oligonucleotide of the compound of the invention can comprise backbone linkage modifications. A backbone linkage modification can be, but is not limited to, a modified version of the phosphodiester present in RNA, such as phosphorothioate (PS), chirally pure phosphorothioate, phosphorodithioate (PS2), phosphonoacetate (PACE), phosphonoacetamide (PACA), thiophosphonoacetate (thioPACE), thiophosphonoacetamide, phosphorothioate prodrug, H-phosphonate, methyl phosphonate, methyl phosphonothioate, methyl phosphate, methyl phosphorothioate, ethyl phosphate, ethyl phosphorothioate, boranophosphate, boranophosphorothioate, methyl boranophosphate, methyl boranophosphorothioate, methyl boranophosphonate, methyl boranophosphonothioate, phosphate, phosphotriester, aminoalkylphosphotriester, and their derivatives. Another modification includes phosphoramidite, phosphoramidate, N3'→P5' phosphoramidate, phosphordiamidate, phosphorothiodiamidate, sulfamate, dimethylenesulfoxide, amide, sulfonate, siloxane, sulfide, sulfone, formacetyl, thioformacetyl, methylene formacetyl, alkenyl, methylenehydrazino, sulfonamide, amide, triazole, oxalyl, carbamate, methyleneimino (MMI), and thioacetamido nucleic acid (TANA); and their derivatives. Examples of chirally pure phosphorothioate linkages are described in e.g. WO2014/010250 (WaVe Life Sciences). Various salts, mixed salts and free acid forms are also included, as well as 3'43' and 2'→5' linkages.

Depending on its length, said first and/or second oligonucleotide of the compound of the invention may comprise or consist of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36 or 37 backbone linkage modifications. It is also encompassed by the invention to introduce more than one distinct backbone modification in said oligonucleotide.

In a preferred embodiment, said first and/or second oligonucleotide of the compound of the invention comprises at least one phosphorothioate modification. In a more preferred embodiment, said first and/or second oligonucleotide of the compound of the invention is fully phosphorothioate modified. In another preferred embodiment, said first and/or second oligonucleotide of the compound of the invention comprises at least one phosphate.

Other chemical modifications of a first and/or second oligonucleotide of the compound of the invention include the substitution of one or more than one of any of the hydrogen atoms with deuterium or tritium, examples of which can be found in e.g. WO2014/022566 (Ased) or WO2015/011694 (Celgene).

With the advent of nucleic acid mimicking technology it has become possible to generate molecules that have a similar, preferably the same hybridization characteristics in kind not necessarily in amount as nucleic acid itself. Such functional equivalents are of course also suitable for use in the invention.

The skilled person will understand that not each scaffold, base, and/or backbone may be modified the same way. Several distinct modified scaffolds, bases and/or backbones may be combined into one single oligonucleotide.

Linking Moiety

In an embodiment of the invention, said linking moiety can be any type of moiety capable of linking (antisense) oligonucleotides to each other. A linking moiety can by hydrophilic, hydrophobic, or amphiphilic. In the context of the invention, a first and a second antisense oligonucleotide "linked to each other by a linking moiety" means that said first and said second antisense oligonucleotide are linked in a compound by a linking moiety so as to form a single compound, said compound comprising or consisting of said first antisense oligonucleotide, a linking moiety and said second antisense oligonucleotide as defined herein. The term "linking moiety" can be interchanged with "spacer" or "linker" throughout the application.

The linkage between an antisense oligonucleotide and a linking moiety may be covalently. Said linkage may be accomplished through a nucleotide linkage, preferably comprising or consisting between 1 to 50 nucleotides, more preferably 4 to 40 nucleotides.

In a preferred embodiment, said linking moiety or spacer comprises or consists of an ethylene glycol monomer, ethylene glycol oligomer or ethylene glycol polymer (also known as polyethylene glycol, PEG). Preferably said linking moiety comprises or consists of at least 1, 2, 3, 4, 5, 6, 7, 8, 9, 10, 11, 12, 13, 14, 15, 16, 17, 18, 19 or 20 ethylene glycol monomers. More preferably said linking moiety comprises or consists of 1 to 20, 3 to 15, 3 to 12, 3 to 10, 3 to 6, 6 to 20, 6 to 15, 6 to 12 or 6 to 10 ethylene glycol monomers. Even more preferably said linking moiety comprises or consists of 1, 2, 3, 4, 5, 6, 7, 8, 9, 10, 11 or 12 ethylene glycol monomers or chains.

In another preferred embodiment, said linking moiety or spacer comprises or consists of any one of the following non-limiting list: N-maleimidopropyloxysuccinimide ester (BMPS), succinimidyl 4-maleimidobutyrate (GMBS), DMSS (Sugo et al. J. Control. Rel. 2016, 237, 1), succinimidyl 3-(2-pyridyldithio)proprionate (SPDP), 4-succinimidyloxycarbonyl-α-methyl-(2-pyridyldithio)toluene (SMPT), succinimidyl 4-(N-maleimidomethyl)cyclohexane-1-carboxylate (SMCC), sulfo-SMCC, succinimidyl 4-formylbenzamide (S-4FB), sulfo-S-4FB, S-HyNic, ω-aminoalkanol (such as 6-aminohexanol, 5-aminopentanol, 12-aminododecanol), ω-mercaptoalkanol (such as 6-mercaptohexanol), ω-hydroxyalkanol (such as 1,6-hexanediol, 1,12-dodecanediol, 1,2-ethanediol, 1,3-propanediol), amino acid (such as β-Ala, Gly, Pro, Hyp, Lys, Cys), dipeptide (such as Val-Cit, or Val-Cit-containing as in Sugo et al. J. Control. Rel. 2016, 237, 1), tripeptide, tetrapeptide, pentapeptide, hexapeptide, heptapeptide, octapeptide, nonapeptide, decapeptide or oligopeptide, piperazine, piperidine, p-aminobenzoyl, p-aminobenzyl carbamate, p-aminobenzyl carboxylate, abasic nucleotides (such as 1,2-dideoxyribosyl, 1-deoxy-2-O-methylribosyl, 1-deoxyazaribosyl), and their derivatives. Examples of linkers are also described in e.g. Leriche et al. *Bioorg. Med. Chem.* 2012, 20, 571, Saneyoshi et al. *J. Org. Chem.* 2017, 82, 1796, U.S. Pat. Nos. 9,732,340 and 9,790,494 (Translate Bio MA, Inc.).

In a more preferred embodiment, said linking moiety is diethylene glycol, triethylene glycol (TEG), tetraethylene glycol, pentaethylene glycol or hexaethylene glycol (HEG). More preferably, said linking moiety is TEG or HEG.

A person skilled in the art will also understand that one or more linking moieties can be incorporated in a compound of the invention. For example, a first and second antisense oligonucleotide of the compound can be linked to each other by the incorporation of a single hexaethylene glycol moiety or by the incorporation of two consecutive triethylene glycol moieties. However, a linking moiety comprising or consisting of one or more linking moieties is still named "a linking moiety" in the context of this invention.

Also encompassed within the scope of the invention is the use of modified PEGylation, wherein said (poly)ethylene glycol is chemically modified and/or contains a moiety attached thereto. In this way said linking moiety acquires an additional property as known in the art. For example said linking moiety becomes cleavable or fluorescent. An example of modified PEGylation includes but is not limited to cleavable PEGylation, wherein the linkage is a degradable (cleavable) linkage. Examples include linkages that are responsive to, for example, pH, light, temperature, reductive or oxidative environments, nucleophiles, synthetic reagents, enzymes, proteases, cathepsin, click-to-release reactions or (other) external stimuli.

It is understood that a linker can exist of a single chemical moiety as mentioned above, or of multiple instances of the same or a combination of different linkers, that ultimately link the two oligonucleotides together.

Attachment of linkers to the first and/or second oligonucleotide of the compound of the invention may be achieved through, for example, amide, carboxamide, ester, ether, thioether, thioester, thiol/maleimide, disulfide, phosphodiester, phosphate, phosphotriester, thiophosphodiester, thiophosphotriester, dithiophosphodiester, phosphorodiamidate, methyl phosphonate, phosphoryl guanidine, phosphorothioate, (R)-phosphorothioate, (S)-phoshorothioate, sulfone, sulfonamide, sulfoxide, sulfodioxide, carbamate, carbonate, urea, guanidine, amidine, hydroxamate, hydroxylamine, imine, xanthate, azide/alkyne, oxime, thiazolidine, azo, hydrazido, hydrazone.

PEGylation, i.e. the attachment of (chemically activated) ethylene glycol chains, of nucleic acids including (antisense) oligonucleotides is well known to a person skilled in the art. PEGylation can be done at the —OH group of the 5' terminal monomer and/or the 3' terminal monomer of a nucleic acid. This can be done directly or through a spacer (e.g. aminoalkyl linker), for example by click chemistry as known by the person skilled in the art.

Composition

In a second aspect, there is provided a composition comprising a compound as described in the previous section entitled "Compound".

In an embodiment of the invention, said composition comprises at least one excipient, and/or wherein said compound comprises at least one conjugated ligand, that may further aid in enhancing the targeting and/or delivery of said composition and/or said compound to a tissue and/or cell and/or into a tissue and/or cell. Compositions as described here are herein referred to as compositions of the invention. A composition of the invention can comprise one or more than one compound of the invention. In the context of this invention, an excipient can be a distinct molecule, but it can also be a conjugated moiety. In the first case, an excipient can be a filler, such as starch. In the latter case, an excipient can for example be a targeting ligand that is linked to the first and/or second oligonucleotide of the compound of the invention.

In a preferred embodiment, said composition is for use as a medicament. Said composition is therefore a pharmaceutical composition. A pharmaceutical composition usually comprises a pharmaceutically accepted carrier, diluent and/or excipient. In a preferred embodiment, a composition of the current invention comprises a compound as defined herein and optionally further comprises a pharmaceutically acceptable formulation, filler, preservative, solubilizer, carrier, diluent, excipient, salt, adjuvant and/or solvent. Such pharmaceutically acceptable carrier, filler, preservative, solubilizer, diluent, salt, adjuvant, solvent and/or excipient may for instance be found in Remington: The Science and Practice of Pharmacy, 20th Edition. Baltimore, Md.: Lippincott Williams & Wilkins, 2000. The compound as described in the invention may possess at least one ionizable group. An ionizable group may be a base or acid, and may be charged or neutral. An ionizable group may be present as ion pair with an appropriate counterion that carries opposite charge(s). Examples of cationic counterions are sodium, potassium, cesium, Tris, lithium, calcium, magnesium, trialkylammonium, triethylammonium, and tetraalkylammonium. Examples of anionic counterions are chloride, bromide, iodide, lactate, mesylate, besylate, triflate, acetate, trifluoroacetate, dichloroacetate, tartrate, lactate, and citrate. Examples of counterions have been described [e.g. Kumar, 2008] which is incorporated here in its entirety by reference].

A pharmaceutical composition may comprise an aid in enhancing the stability, solubility, absorption, bioavailability, activity, pharmacokinetics, pharmacodynamics, cellular uptake, and intracellular trafficking of said compound, in particular an excipient capable of forming complexes, nanoparticles, microparticles, nanotubes, nanogels, hydrogels, poloxamers or pluronics, polymersomes, colloids, microbubbles, vesicles, micelles, lipoplexes, and/or liposomes. Examples of nanoparticles include polymeric nanoparticles, (mixed) metal nanoparticles, carbon nanoparticles, gold nanoparticles, magnetic nanoparticles, silica nanoparticles, lipid nanoparticles, sugar particles, protein nanoparticles and peptide nanoparticles. An example of the combination of nanoparticles and oligonucleotides is spherical nucleic acid (SNA), as in e.g. Barnaby et al. *Cancer Treat. Res.* 2015, 166, 23.

A preferred composition comprises at least one excipient that may further aid in enhancing the targeting and/or delivery of said composition and/or said compound to a tissue and/or a cell and/or into a tissue and/or a cell. A preferred tissue or cell is a muscle tissue or muscle cell.

Many of these excipients are known in the art (e.g. see Bruno, 2011) and may be categorized as a first type of excipient. Examples of first type of excipients include polymers (e.g. polyethyleneimine (PEI), polypropyleneimine (PPI), dextran derivatives, butylcyanoacrylate (PBCA), hexylcyanoacrylate (PHCA), poly(lactic-co-glycolic acid) (PLGA), polyamines (e.g. spermine, spermidine, putrescine, cadaverine), chitosan, poly(amido amines) (PAMAM), poly (ester amine), polyvinyl ether, polyvinyl pyrrolidone (PVP), polyethylene glycol (PEG) cyclodextrins, hyaluronic acid, colominic acid, and derivatives thereof), dendrimers (e.g. poly(amidoamine)), lipids {e.g. 1,2-dioleoyl-3-dimethylammonium propane (DODAP), dioleoyldimethylammonium chloride (DODAC), phosphatidylcholine derivatives [e.g 1,2-distearoyl-sn-glycero-3-phosphocholine (DSPC)], lyso-phosphatidylcholine derivatives [e.g. 1-stearoyl-2-lyso-sn-glycero-3-phosphocholine (S-LysoPC)], sphingomyeline, 2-{3-[Bis-(3-amino-propyl)-amino]-propylamino}-N-ditetracedyl carbamoyl methylacetamide (RPR209120), phosphoglycerol derivatives [e.g. 1,2-dipalmitoyl-sn-glycero-3-phosphoglycerol,sodium salt (DPPG-Na), phosphaticid acid derivatives [1,2-di stearoyl-sn-glycero-3-phosphaticid acid, sodium salt (DSPA), phosphatidylethanolamine derivatives [e.g. dioleoyl-L-R-phosphatidylethanolamine (DOPE), 1,2-distearoyl-sn-glycero-3-phosphoethanolamine (DSPE), 2-diphytanoyl-sn-glycero-3-phosphoethanolamine (DPhyPE),], N-[1-(2,3-dioleoyloxy)propyl]-N,N,N-trimethylammonium (DOTAP), N-[1-(2,3-dioleyloxy)propyl]-N,N,N-trimethylammonium (DOTMA), 1,3-di-oleoyloxy-2-(6-carboxy-spermyl)-propylamid (DOSPER), (1,2-dimyristyolxypropyl-3-dimethylhydroxy ethyl ammonium (DMRIE), (N1-cholesteryloxycarbonyl-3,7-diazanonane-1, 9-diamine (CDAN), dimethyldioctadecylammonium bromide (DDAB), 1-palmitoyl-2-oleoyl-sn-glycerol-3-phosphocholine (POPC), (b-L-Arginyl-2,3-L-diaminopropionic acid-N-palmityl-N-olelyl-amide trihydrochloride (AtuFECT01), N,N-dimethyl-3-aminopropane derivatives [e.g. 1,2-distearoyloxy-N,N-dimethyl-3-aminopropane (DSDMA), 1,2-dioleyloxy-N,N-dimethyl-3-aminopropane (DoDMA), 1,2-Dilinoleyloxy-N,N-3-dimethylaminopropane (DLinDMA), 2,2-dilinoleyl-4-dimethylaminomethyl [1,3]-dioxolane (DLin-K-DMA), phosphatidylserine derivatives [1,2-dioleyl-sn-glycero-3-phospho-L-serine, sodium salt (DOPS)], proteins (e.g. albumin, gelatins, atellocollagen), and peptides (e.g. protamine, PepFects, NickFects, polyarginine, polylysine, CADY, MPG). Carbohydrates and carbohydrate clusters as described below, when used as distinct compounds, are also suitable for use as a first type of excipient.

Another preferred composition may comprise at least one excipient categorized as a second type of excipient. A second type of excipient may comprise or contain a conjugate group as described herein to enhance targeting and/or delivery of the composition and/or of the compound of the invention to a tissue and/or cell and/or into a tissue and/or cell, as for example muscle tissue or muscle cell. The conjugate group may display one or more different or identical ligands. Examples of conjugate group ligands are e.g. peptides, carbohydrates or mixtures of carbohydrates (Han et al., Nature Communications, 2016, doi:10.1038/ncomms10981; Cao et al., Mol. Ther. Nucleic Acids, 2016, doi:10.1038/mtna.2016.46), proteins, small molecules, antibodies, polymers, drugs. Examples of carbohydrate conjugate group ligands are glucose, mannose, galactose, maltose, fructose, N-acetylgalactosamine (GalNac), glucosamine, N-acetylglucosamine (GlcNAc), glucose-6-phosphate, mannose-6-phosphate, and maltotriose. Carbohydrates may be present in plurality, for example as end groups on dendritic or branched linker moieties that link the carbohydrates to the component of the composition. A carbohydrate can also be comprised in a carbohydrate cluster portion, such as a GalNAc cluster portion. A carbohydrate cluster portion can comprise a targeting moiety and, optionally, a conjugate linker. In some embodiments, the carbohydrate cluster portion comprises 1, 2, 3, 4, 5, 6, or more GalNAc groups. As used herein, "carbohydrate cluster" means a compound having one or more carbohydrate residues attached to a scaffold or linker group, (see, e.g., Maier et al., "Synthesis of Antisense Oligonucleotides Conjugated to a Multivalent Carbohydrate Cluster for Cellular Targeting," Bioconjugate Chem., 2003, (14): 18-29; Rensen et al., "Design and Synthesis of Novel N-Acetylgalactosamine-Terminated Glycolipids for Targeting of Lipoproteins to the Hepatic Asiaglycoprotein Receptor," J. Med. Chem. 2004, (47): 5798-5808). In this context, "modified carbohydrate" means any carbohydrate having one or more chemical modifications relative to naturally occurring carbohydrates. As used herein, "carbohydrate derivative" means any compound which may be synthesized using a carbohydrate as a starting material or intermediate. As used herein, "carbohydrate" means a naturally occurring carbohydrate, a modified carbohydrate, or a carbohydrate derivative. Both types of excipients may be combined together into one single composition as identified herein.

The skilled person may select, combine and/or adapt one or more of the above or other alternative excipients and delivery systems to formulate and deliver a compound for use in the present invention.

Such a pharmaceutical composition of the invention may be administered in an effective concentration at set times to an animal, preferably a mammal. More preferred mammal is a human being. A compound or a composition as defined herein for use of the invention may be suitable for direct administration to a cell, tissue and/or an organ in vivo of individuals affected by or at risk of developing a disease or condition as identified herein, and may be administered directly in vivo, ex vivo or in vitro. Administration may be via topical, systemic and/or parenteral routes, for example intravenous, subcutaneous, intraperitoneal, intrathecal, intramuscular, ocular, nasal, urogenital, intradermal, dermal, enteral, intravitreal, intracavernous, intracerebral, intrathecal, epidural or oral route.

Preferably, such a pharmaceutical composition of the invention may be encapsulated in the form of an emulsion, suspension, pill, tablet, capsule or soft-gel for oral delivery, or in the form of aerosol or dry powder for delivery to the respiratory tract and lungs.

In another embodiment of the invention, said compound may be used together with another compound already known to be used for the treatment of said disease. Such other compounds may be used for reducing inflammation, preferably for reducing muscle tissue inflammation, and/or an adjunct compound for improving muscle fiber function, integrity and/or survival and/or improve, increase or restore cardiac function.

Examples are, but not limited to, a steroid, preferably a (gluco)corticosteroid, steroid-like agent (preferably vamorolone (VBP15)), epicatechin, an ACE inhibitor (preferably perindopril), and HDAC inhibitor (preferably givinostat), an angiotensin II type 1 receptor blocker (preferably losartan), angiotensin peptide (1-7) (preferably TXA127), a tumor necrosis factor-alpha (TNFα) inhibitor, a TGFβ inhibitor (preferably decorin), a NF-κB inhibitor (preferably edasalonexent (CAT-1004)), human recombinant biglycan, a source of mIGF-1, a myostatin inhibitor (preferably PF-06252616 or RG6206), mannose-6-phosphate, an antioxidant (preferably idebenone), an ion channel inhibitor, dantrolene, a protease inhibitor, a phosphodiesterase inhibitor (preferably a PDE5 inhibitor, such as sildenafil or tadalafil), an anti-inflammatory and/or antifibrotic agent (preferably HT-100), an utrophin modulator (preferably ezutromid), metformin, creatine monohydrate (CrM), heparin, a granulocyte colony-stimulating factor (GCSF) (preferably filgrastim), a connective tissue growth factor (CTGF/CCN2) inhibitor (preferably FG-3019), a calcium modulator (preferably AT-300), an androgen receptor modulator (preferably DT-200), L-citrulline, and/or L-arginine. Such combined use may be a sequential use: each component is administered in a distinct fashion, perhaps as a distinct composition. Alternatively each compound may be used together in a single composition.

Compounds that are comprised in a composition of the invention can also be provided separately, for example to allow sequential administration of the active components of the composition of the invention. In such a case, the composition of the invention is a combination of compounds comprising at least a compound of the invention with or without a conjugated ligand, at least one excipient, as described above.

Method

In a third aspect, there is provided a method for preventing, treating, curing, ameliorating and/or delaying a condition or disease as defined in the previous sections in an individual, in a cell (preferably a muscle cell), tissue (preferably muscle tissue) or organ of said individual. The method comprises administering a compound (as described in the section entitled "Compound") or a composition (as described in the section entitled "Composition") of the invention to said individual or a subject in the need thereof.

The method of the invention wherein a compound or a composition as defined herein may be suitable for administration to a cell (preferably a muscle cell), tissue (preferably muscle tissue) and/or an organ in vivo of individuals affected by any of the herein defined diseases or at risk of developing an inflammatory disorder, and may be administered in vivo, ex vivo or in vitro. An individual or a subject in need is preferably a mammal, more preferably a human being. Alternately, a subject is not a human. Administration may be via topical, systemic and/or parenteral routes, for example intravenous, subcutaneous, nasal, ocular, intraperitoneal, intrathecal, intramuscular, intracavernous, urogenital, intradermal, dermal, enteral, intravitreal, intracerebral, intrathecal, epidural or oral route.

In another embodiment, in a method of the invention, a concentration of a compound or composition is ranged from 0.01 nM to 1 μM. More preferably, the concentration used is from 0.05 to 500 nM, or from 0.1 to 500 nM, or from 0.02 to 500 nM, or from 0.05 to 500 nM, even more preferably from 1 to 200 nM.

Dose ranges of a compound or composition of the invention are preferably designed on the basis of rising dose studies in clinical trials (in vivo use) for which rigorous protocol requirements exist. A compound as defined herein may be used at a dose which is ranged from 0.01 to 200 mg/kg or 0.05 to 100 mg/kg or 0.1 to 50 mg/kg or 0.1 to 20 mg/kg, preferably from 0.5 to 10 mg/kg.

The ranges of concentration or dose of a compound or composition as given above are preferred concentrations or doses for in vitro or ex vivo uses. The skilled person will understand that depending on the identity of the compound used, the target cell to be treated, the gene target and its expression levels, the medium used and the transfection and incubation conditions, the concentration or dose of the compound used may further vary and may need to be optimised any further.

In an embodiment of this aspect of the invention, there is provided a method for preventing, treating, and/or delaying Duchenne Muscular Dystrophy (DMD), comprising administering to a subject a compound of the invention, or a composition of the invention.

In another embodiment of the invention, there is provided a method for diagnosis wherein the compound of the invention is provided with a radioactive label or fluorescent label.

Use

In a fourth aspect, there is provided a compound (as described in the section entitled "Compound") or a composition (as described in the section entitled "Composition") for use as a medicament or part of therapy, or applications in which said compound or composition exert their activity preferably intracellularly.

In a preferred embodiment, a compound or composition of the invention is for use as a medicament or part of a therapy for preventing, delaying, curing, ameliorating and/or treating Duchenne Muscular Dystrophy (DMD).

In a fifth aspect, there is provided the use of a compound (as described in the section entitled "Compound") or a composition (as described in the section entitled "Composition") in the manufacture of a medicament. Preferably, said use of a compound or a composition in the manufacture of a medicament is for preventing, delaying, curing, ameliorating and/or treating Duchenne Muscular Dystrophy (DMD).

Third Antisense Oligonucleotide

Another aspect of the invention relates to an antisense oligonucleotide, i.e. "third antisense oligonucleotide". Said third antisense oligonucleotide is not a compound of the invention comprising or consisting two antisense oligonucleotides linked to each other by a linking moiety, wherein a first antisense oligonucleotide (AON) is complementary to or binds to or targets or hybridizes to or overlaps with at least a part of SEQ ID NO: 3, and wherein a second antisense oligonucleotide (AON) is complementary to or binds to or targets or hybridizes to or overlaps with at least a part of SEQ ID NO: 4, wherein SEQ ID NO: 3 and 4 are located within exon 51 of dystrophin pre-mRNA. Said third antisense oligonucleotide is complementary to or binds to or targets or hybridizes to or overlaps with at least a part of exon 51 of dystrophin pre-mRNA, preferably for use as a medicament, more preferably for treating, preventing and/or delaying Duchenne Muscular Dystrophy (DMD) and more preferably for inducing the skipping of exon 51 of dystrophin pre-mRNA as defined herein. Preferably, said exon 51 of dystrophin pre-mRNA is from a human and is represented by a nucleotide sequence with SEQ ID NO: 2.

In a preferred embodiment of this aspect of the invention, said third antisense oligonucleotide is represented by a nucleotide sequence comprising or consisting of SEQ ID NO: 16351 or 16352, or by a nucleotide sequence comprising or consisting of a fragment of SEQ ID NO: 16351 or 16352. Said SEQ ID NO: 16351 is represented by the sequence TAAGTTC*TGTC*C*AAGTC*AAGGAAGATGGC*AT and said SEQ ID NO: 16352 is represented by the sequence TC*AAGGAAGATGGC*ATTAAGTTC*TGTC*C*AAG, wherein C* is 5-methylcytosine, T is 5-methyluracil and wherein T and G are LNA modified bases. Preferably, each monomer of said third antisense oligonucleotide is a RNA monomer. Also preferred is that said third antisense oligonucleotide is single stranded. Further, also preferred is the presence of at least one 2'-substituted monomer, preferably a 2'-O-methylated monomer, and/or the presence of at least one phosphorothioate backbone linkage. More preferably, all backbone linkages are phosphorothioate backbone linkages.

In another preferred embodiment of this aspect of the invention, said third antisense oligonucleotide comprises or consists of a linking moiety (as defined in the section "linking moiety" earlier herein and applying mutatis mutandis to said third antisense oligonucleotide) at the 5' terminal monomer and/or at the 3' terminal monomer of said third antisense oligonucleotide.

The following aspects described in the context of a compound of the invention (see above) also apply to said third antisense oligonucleotide mutatis mutandis:
 "Further chemical modifications of said first and/or second antisense oligonucleotide of the compound";
 "Composition"; and
 "Use".

Definitions

In this document and in its claims, the verb "to comprise" and its conjugations is used in its non-limiting sense to mean that items following the word are included, but items not specifically mentioned are not excluded. In addition the verb "to consist" may be replaced by "to consist essentially of" meaning that a compound or an oligonucleotide or a composition as defined herein may comprise additional component(s) than the ones specifically identified, said additional component(s) not altering the unique characteristic of the invention. In addition, reference to an element by the indefinite article "a" or "an" does not exclude the possibility that more than one of the element is present, unless the context clearly requires that there be one and only one of the elements. The indefinite article "a" or "an" thus usually means "at least one".

Each embodiment as identified herein may be combined together unless otherwise indicated. All patent and literature references cited in the present specification are hereby incorporated by reference in their entirety.

Throughout the application, the word "binds", "targets", "hybridizes" could be used interchangeably when used in the context of an antisense oligonucleotide which is complementary to a part of a pre-mRNA as identified herein. In the context of the invention, "hybridizes" is used under physiological conditions in a cell, preferably a muscular cell unless otherwise indicated.

When a structural formula or chemical name is understood by the skilled person to have chiral centers, yet no chirality is indicated, for each chiral center individual reference is made to all three of either the racemic mixture, the pure R enantiomer, and the pure S enantiomer.

Whenever a parameter of a substance is discussed in the context of this invention, it is assumed that unless otherwise specified, the parameter is determined, measured, or manifested under physiological conditions. Physiological conditions are known to a person skilled in the art, and comprise aqueous solvent systems, atmospheric pressure, pH-values between 6 and 8, a temperature ranging from room temperature to about 37° C. (from about 20° C. to about 40° C.), and a suitable concentration of buffer salts or other components. It is understood that charge is often associated with equilibrium. A moiety that is said to carry or bear a charge is a moiety that will be found in a state where it bears or carries such a charge more often than that it does not bear or carry such a charge. As such, an atom that is indicated in this disclosure to be charged could be non-charged under specific conditions, and a neutral moiety could be charged under specific conditions, as is understood by a person skilled in the art.

Generally, a substitution replaces one moiety, which might be hydrogen, by another moiety. When considering the carbon skeleton of organic molecules, an RNA monomer is inherently 2'-substituted because it has a hydroxyl moiety at its 2'-position. A DNA monomer would therefore not be 2'-substituted, and an RNA monomer can be seen as a 2'-substituted DNA monomer. When an RNA monomer in turn is 2'-substituted, this substitution can have replaced either the 2'-OH or the 2'-H. When an RNA monomer is 2'-O-substituted, this substitution replaces the H of the 2'-OH moiety. As a non-limiting example, 2'-O-methyl RNA is a 2'-substituted monomer (—OMe substitutes —H) and a 2'-substituted RNA monomer (—OMe substitutes —OH) and a 2'-O-substituted RNA monomer (-Me substitutes —H), while 2'-F RNA is a 2'-substituted RNA monomer (—F substitutes —OH or —H) yet not a 2'-O-substituted RNA monomer (2'-O is either no longer present, or is not substituted). 2'-F RNA where F substituted 2'-OH is 2'-F-2'-deoxy RNA, which is also 2'-F DNA.

In the context of this invention, a decrease or increase of a parameter to be assessed means a change of at least 5% of the value corresponding to that parameter. More preferably, a decrease or increase of the value means a change of at least 10%, even more preferably at least 20%, at least 30%, at least 40%, at least 50%, at least 70%, at least 90%, or 100%. In this latter case, it can be the case that there is no longer a detectable value associated with the parameter.

The use of a substance as a medicament as described in this document can also be interpreted as the use of said substance in the manufacture of a medicament. Similarly, whenever a substance is used for treatment or as a medicament, it can also be used for the manufacture of a medicament for treatment.

The word "about" or "approximately" when used in association with a numerical value (e.g. about 10) preferably means that the value may be the given value (of 10) more or less 0.1% of the value.

Compounds or compositions according to this invention are preferably for use in methods or uses according to this invention.

As will be understood by a skilled person, throughout this application, the terms "BNA", "BNA scaffold", "BNA nucleotide", "BNA nucleoside", "BNA modification", or "BNA scaffold modification" may be replaced by conformationally restricted scaffold modification, locked scaffold modification, locked nucleotide, locked nucleoside, locked monomer, or Tm enhancing scaffold modification, or high-affinity modification and the like, as appropriately.

"Sequence identity" is herein defined as a relationship between two or more nucleic acid (polynucleotide, nucleic acid or nucleotide or oligonucleotide) sequences, as determined by comparing the sequences. In a preferred embodiment, sequence identity is calculated based on the full length of two given SEQ ID NO or on part thereof. Part thereof preferably means at least 50%, 60%, 70%, 80%, 90%, or 100% of both SEQ ID NO. In the art, "identity" also means the degree of sequence relatedness between nucleic acid sequences, as the case may be, as determined by the match between strings of such sequences.

Preferred methods to determine identity are designed to give the largest match between the sequences tested. Methods to determine identity and similarity are codified in publicly available computer programs. Preferred computer program methods to determine identity and similarity between two sequences include e.g. the GCG program package (Devereux, J., et al., Nucleic Acids Research 12 (1): 387 (1984)), BestFit, BLASTN, and FASTA (Altschul, S. F. et al., J. Mol. Biol. 215:403-410 (1990). The BLAST X program is publicly available from NCBI and other sources (BLAST Manual, Altschul, S., et al., NCBI NLM NIH Bethesda, Md. 20894; Altschul, S., et al., J. Mol. Biol. 215:403-410 (1990). The well-known Smith Waterman algorithm may also be used to determine identity.

Preferred parameters for nucleic acid comparison include the following: Algorithm: Needleman and Wunsch, J. Mol. Biol. 48:443-453 (1970); Comparison matrix: matches=+10, mismatch=0; Gap Penalty: 50; Gap Length Penalty: 3. Available as the Gap program from Genetics Computer Group, located in Madison, Wis. Given above are the default parameters for nucleic acid comparisons.

Hybridization conditions for a nucleic acid molecule may have low or medium or high stringency (southern blotting procedures). Low or medium or high stringency conditions means pre-hybridization and hybridization at 42° C. in 5×SSPE, 0.3% SDS, 200 pg/ml sheared and denatured salmon sperm DNA, and either 25% or 35% or 50% formamide for low or medium or high stringencies respectively. Subsequently, the hybridization reaction is washed three times for 30 minutes each using 2×SSC, 0.2% SDS and either 55° C. or 65° C., or 75° C. for low or medium or high stringencies respectively.

The following examples are offered for illustrative purposes only, and are not intended to limit the scope of the present invention in any way.

Overview of the sequence listing

| SEQ ID NO | Description |
|---|---|
| 1 | Human dystrophin protein |
| 2 | Exon 51 |
| 3 | ESE motif 1 of exon 51 |
| 4 | ESE motif 2 of exon 51 |
| 5 | Reverse complement of SEQ ID NO: 3 |
| 6 | Reverse complement of SEQ ID NO: 4 |
| 7 | Drisapersen |
| 8 | Eteplirsen |
| 9-13 | PCR primers |
| 14-197 | Represent preferred AON 1 |
| 198-398 | Represent preferred AON 2 |
| 399-581 | Represent preferred AON 1, wherein all cytosine bases are 5-methylcytosine |
| 582-773 | Represent preferred AON 2, wherein all cytosine bases are 5-methylcytosine |
| 774-957 | Represent preferred AON 1, wherein all uracil bases are 5-methyluracil (i.e. thymine) |
| 958-1155 | Represent preferred AON 2, wherein all uracil bases are 5-methyluracil (i.e. thymine) |
| 1156-1338 | Represent preferred AON 1, wherein all cytosine bases are 5-methylcytosine and all uracil bases are 5-methyluracil (i.e. thymine) |
| 1339-1528 | Represent preferred AON 2, wherein all cytosine bases are 5-methylcytosine and all uracil bases are 5-methyluracil (i.e. thymine) |
| 1529-1913 | Represent preferred AON 1 and AON 2, wherein 5'terminal monomer comprises a BNA scaffold modification |
| 1914-2298 | Represent preferred AON 1 and AON 2, wherein 3'terminal monomer comprises a BNA scaffold modification |
| 2299-2683 | Represent preferred AON 1 and AON 2, wherein 5'and 3' terminal monomers comprise a BNA scaffold modification |
| 2684-3068 | Represent preferred AON 1 and AON 2, wherein the two 5'terminal monomers comprise a BNA scaffold modification |
| 3069-3453 | Represent preferred AON 1 and AON 2, wherein the two 3'terminal monomers comprise a BNA scaffold modification |
| 3454-3838 | Represent preferred AON 1 and AON 2 wherein the two 5' and the two 3' terminal monomers comprise a BNA scaffold modification |
| 3839-4213 | Represent preferred AON 1 and AON 2, wherein 5'terminal monomer comprises a BNA scaffold modification and wherein all cytosine bases are 5-methylcytosine |
| 4214-4588 | Represent preferred AON 1 and AON 2, wherein 3'terminal monomer comprises a BNA scaffold modification and wherein all cytosine bases are 5-methylcytosine |
| 4589-4963 | Represent preferred AON 1 and AON 2, wherein 5'and 3' terminal monomers comprise a BNA scaffold modification and wherein all cytosine bases are 5-methylcytosine |
| 4964-5338 | Represent preferred AON 1 and AON 2, wherein the two 5'terminal monomers comprise a BNA scaffold modification and wherein all cytosine bases are 5-methylcytosine |

-continued

Overview of the sequence listing

| SEQ ID NO | Description |
|---|---|
| 5339-5713 | Represent preferred AON 1 and AON 2, wherein the two 3'terminal monomers comprise a BNA scaffold modification and wherein all cytosine bases are 5-methylcytosine |
| 5714-6088 | Represent preferred AON 1 and AON 2, wherein the two 5' and the two 3' terminal monomers comprise a BNA scaffold modification and wherein all cytosine bases are 5-methylcytosine |
| 6089-6470 | Represent preferred AON 1 and AON 2, wherein 5'terminal monomer comprises a BNA scaffold modification and wherein all uracil bases are 5-methyluracil (i.e. thymine) |
| 6471-6852 | Represent preferred AON 1 and AON 2, wherein 3'terminal monomer comprises a BNA scaffold modification and wherein all uracil bases are 5-methyluracil (i.e. thymine) |
| 6853-7234 | Represent preferred AON 1 and AON 2, wherein 5'and 3' terminal monomers comprise a BNA scaffold modification and wherein all uracil bases are 5-methyluracil (i.e. thymine) |
| 7235-7616 | Represent preferred AON 1 and AON 2, wherein the two 5'terminal monomers comprise a BNA scaffold modification and wherein all uracil bases are 5-methyluracil (i.e. thymine) |
| 7617-7998 | Represent preferred AON 1 and AON 2, wherein the two 3'terminal monomers comprise a BNA scaffold modification and wherein all uracil bases are 5-methyluracil (i.e. thymine) |
| 7999-8380 | Represent preferred AON 1 and AON 2, wherein the two 5' and the two 3' terminal monomers comprise a BNA scaffold modification and wherein all uracil bases are 5-methyluracil (i.e. thymine) |
| 8381-8753 | Represent preferred AON 1 and AON 2, wherein 5'terminal monomer comprises a BNA scaffold modification and wherein all cytosine bases are 5-methylcytosine and all uracil bases are 5-methyluracil (i.e. thymine) |
| 8754-9126 | Represent preferred AON 1 and AON 2, wherein 3'terminal monomer comprises a BNA scaffold modification and wherein all cytosine bases are 5-methylcytosine and all uracil bases are 5-methyluracil (i.e. thymine) |
| 9127-9499 | Represent preferred AON 1 and AON 2, wherein 5'and 3' terminal monomers comprise a BNA scaffold modification and wherein all cytosine bases are 5-methylcytosine and all uracil bases are 5-methyluracil (i.e. thymine) |
| 9500-9872 | Represent preferred AON 1 and AON 2, wherein the two 5'terminal monomers comprise a BNA scaffold modification and wherein all cytosine bases are 5-methylcytosine and all uracil bases are 5-methyluracil (i.e. thymine) |
| 9873-10245 | Represent preferred AON 1 and AON 2, wherein the two 3'terminal monomers comprise a BNA scaffold modification and wherein all cytosine bases are 5-methylcytosine and all uracil bases are 5-methyluracil (i.e. thymine) |
| 10246-10618 | Represent preferred AON 1 and AON 2, wherein the two 5' and the two 3' terminal monomers comprise a BNA scaffold modification and wherein all cytosine bases are 5-methylcytosine and all uracil bases are 5-methyluracil (i.e. thymine) |
| 10619-10837 | Represent preferred AON 1 and AON 2, wherein 1 or 2 non-terminal monomers comprise a BNA scaffold modification |
| 10838-11056 | Represent preferred AON 1 and AON 2, wherein 1 or 2 non-terminal monomers comprise a BNA scaffold modification and wherein all cytosine bases are 5-methylcytosine |
| 11057-11275 | Represent preferred AON 1 and AON 2, wherein 1 or 2 non-terminal monomers comprise a BNA scaffold modification and wherein all uracil bases are 5-methyluracil (i.e. thymine) |
| 11276-11494 | Represent preferred AON 1 and AON 2, wherein 1 or 2 non-terminal monomers comprise a BNA scaffold modification and wherein all cytosine bases are 5-methylcytosine and all uracil bases are 5-methyluracil (i.e. thymine) |
| 11495-11682 | Represent preferred AON 1 and AON 2, wherein 1 or 2 non-terminal monomers and 5'terminal monomer comprises a BNA scaffold modification |
| 11683-11870 | Represent preferred AON 1 and AON 2, wherein 1 or 2 non-terminal monomers and 5'terminal monomer comprises a BNA scaffold modification and wherein all cytosine bases are 5-methylcytosine |
| 11871-12058 | Represent preferred AON 1 and AON 2, wherein 1 or 2 non-terminal monomers and 5'terminal monomer comprises a BNA scaffold modification and wherein all uracil bases are 5-methyluracil (i.e. thymine) |
| 12059-12246 | Represent preferred AON 1 and AON 2, wherein 1 or 2 non-terminal monomers and 5'terminal monomer comprises a BNA scaffold modification and wherein all cytosine bases are 5-methylcytosine and all uracil bases are 5-methyluracil (i.e. thymine) |
| 12247-12425 | Represent preferred AON 1 and AON 2, wherein 1 or 2 non-terminal monomers and 3'terminal monomer comprises a BNA scaffold modification |
| 12426-12604 | Represent preferred AON 1 and AON 2, wherein 1 or 2 non-terminal monomers and 3'terminal monomer comprises a BNA scaffold modification and wherein all cytosine bases are 5-methylcytosine |

-continued

| Overview of the sequence listing | |
|---|---|
| SEQ ID NO | Description |
| 12605-12783 | Represent preferred AON 1 and AON 2, wherein 1 or 2 non-terminal monomers and 3'terminal monomer comprises a BNA scaffold modification and wherein all uracil bases are 5-methyluracil (i.e. thymine) |
| 12784-12962 | Represent preferred AON 1 and AON 2, wherein 1 or 2 non-terminal monomers and 3'terminal monomer comprises a BNA scaffold modification and wherein all cytosine bases are 5-methylcytosine and all uracil bases are 5-methyluracil (i.e. thymine) |
| 12963-13181 | Represent preferred AON 1 and AON 2, wherein 1 or 2 non-terminal monomers and 5'and 3' terminal monomers comprise a BNA scaffold modification |
| 13182-13400 | Represent preferred AON 1 and AON 2, wherein 1 or 2 non-terminal monomers and 5'and 3' terminal monomers comprise a BNA scaffold modification and wherein all cytosine bases are 5-methylcytosine |
| 13401-13619 | Represent preferred AON 1 and AON 2, wherein 1 or 2 non-terminal monomers and 5'and 3' terminal monomers comprise a BNA scaffold modification and wherein all uracil bases are 5-methyluracil (i.e. thymine) |
| 13620-13838 | Represent preferred AON 1 and AON 2, wherein 5'and 3' terminal monomers comprise a BNA scaffold modification and wherein all cytosine bases are 5-methylcytosine and all uracil bases are 5-methyluracil (i.e. thymine) |
| 13839-14026 | Represent preferred AON 1 and AON 2, wherein 1 or 2 non-terminal monomers and the two 5'terminal monomers comprise a BNA scaffold modification |
| 14027-14214 | Represent preferred AON 1 and AON 2, wherein 1 or 2 non-terminal monomers and the two 5'terminal monomers comprise a BNA scaffold modification and wherein all cytosine bases are 5-methylcytosine |
| 14215-14402 | Represent preferred AON 1 and AON 2, wherein 1 or 2 non-terminal monomers and the two 5'terminal monomers comprise a BNA scaffold modification and wherein all uracil bases are 5-methyluracil (i.e. thymine) |
| 14403-14590 | Represent preferred AON 1 and AON 2, wherein 1 or 2 non-terminal monomers and the two 5'terminal monomers comprise a BNA scaffold modification and wherein all cytosine bases are 5-methylcytosine and all uracil bases are 5-methyluracil (i.e. thymine) |
| 14591-14769 | Represent preferred AON 1 and AON 2, wherein 1 or 2 non-terminal monomers and the two 3'terminal monomers comprise a BNA scaffold modification |
| 14770-14948 | Represent preferred AON 1 and AON 2, wherein 1 or 2 non-terminal monomers and the two 3'terminal monomers comprise a BNA scaffold modification and wherein all cytosine bases are 5-methylcytosine |
| 14949-15127 | Represent preferred AON 1 and AON 2, wherein 1 or 2 non-terminal monomers and the two 3'terminal monomers comprise a BNA scaffold modification and wherein all uracil bases are 5-methyluracil (i.e. thymine) |
| 15128-15306 | Represent preferred AON 1 and AON 2, wherein 1 or 2 non-terminal monomers and the two 3'terminal monomers comprise a BNA scaffold modification and wherein all cytosine bases are 5-methylcytosine and all uracil bases are 5-methyluracil (i.e. thymine) |
| 15307-15457 | Represent preferred AON 1 and AON 2, wherein 1 or 2 non-terminal monomers and the two 5' and the two 3' terminal monomers comprise a BNA scaffold modification |
| 15458-15608 | Represent preferred AON 1 and AON 2, wherein 1 or 2 non-terminal monomers and the two 5' and the two 3' terminal monomers comprise a BNA scaffold modification and wherein all cytosine bases are 5-methylcytosine |
| 15609-15759 | Represent preferred AON 1 and AON 2, wherein 1 or 2 non-terminal monomers and the two 5' and the two 3' terminal monomers comprise a BNA scaffold modification and wherein all uracil bases are 5-methyluracil (i.e. thymine) |
| 15760-15910 | Represent preferred AON 1 and AON 2, wherein 1 or 2 non-terminal monomers and the two 5' and the two 3' terminal monomers comprise a BNA scaffold modification and wherein all cytosine bases are 5-methylcytosine and all uracil bases are 5-methyluracil (i.e. thymine) |
| 15911-15947 | Represent preferred AON 1 with specific monomers comprising a BNA scaffold modification |
| 15948-15976 | Represent preferred AON 2 with specific monomers comprising a BNA scaffold modification |
| 15977-16013 | Represent preferred AON 1 with specific monomers comprising a BNA scaffold modification, wherein all cytosine bases are 5-methylcytosine |
| 16014-16042 | Represent preferred AON 2 with specific monomers comprising a BNA scaffold modification, wherein all cytosine bases are 5-methylcytosine |
| 16043-16079 | Represent preferred AON 1 with specific monomers comprising a BNA scaffold modification, wherein all uracil bases are 5-methyluracil (i.e. thymine) |
| 16080-16108 | Represent preferred AON 2 with specific monomers comprising a BNA scaffold modification, wherein all uracil bases are 5-methyluracil (i.e. thymine) |

| Overview of the sequence listing | |
|---|---|
| SEQ ID NO | Description |
| 16109-16145 | Represent preferred AON 1 with specific monomers comprising a BNA scaffold modification, wherein all cytosine bases are 5-methylcytosine and all uracil bases are 5-methyluracil (i.e. thymine) |
| 16146-16174 | Represent preferred AON 2 with specific monomers comprising a BNA scaffold modification, wherein all cytosine bases are 5-methylcytosine and all uracil bases are 5-methyluracil (i.e. thymine) |
| 16175-16214 | 5'-Portion of Preferred compounds of the invention (TEG or HEG linker) |
| 16215-16254 | 5'-Portion of Preferred compounds of the invention (TEG or HEG linker), wherein all cytosine bases are 5-methylcytosine |
| 16255-16294 | 5'-Portion of Preferred compounds of the invention (TEG or HEG linker), wherein all uracil bases are 5-methyluracil (i.e. thymine) |
| 16295-16334 | 5'-Portion of Preferred compounds of the invention (TEG or HEG linker), wherein all cytosine bases are 5-methylcytosine and all uracil bases are 5-methyluracil (i.e. thymine) |
| 16335-16350 | 5'-Portion of More preferred compounds of the invention (TEG or HEG linker) |
| 16351-16352 | Preferred third AON of the invention |
| 16353 | AON |
| 16354-16393 | 3'-Portion of Preferred compounds of the invention (TEG or HEG linker) |
| 16394-16433 | 3'-Portion of Preferred compounds of the invention (TEG or HEG linker), wherein all cytosine bases are 5-methylcytosine |
| 16434-16473 | 3'-Portion of Preferred compounds of the invention (TEG or HEG linker), wherein all uracil bases are 5-methyluracil (i.e. thymine) |
| 16474-16513 | 3'-Portion of Preferred compounds of the invention (TEG or HEG linker), wherein all cytosine bases are 5-methylcytosine and all uracil bases are 5-methyluracil (i.e. thymine) |
| 16514-16529 | 3'-Portion of More preferred compounds of the invention (TEG or HEG linker) |

EXAMPLES

Example 1 (In Vitro)

Material and Methods

Compounds

All antisense oligonucleotides (AONs) (Table 3, FIG. 1) had a phosphorothioate backbone with 2'-O-methyl monomers and at least one LNA modification (SEQ ID NO: 16353, 16026 and 15980), the same applies to the first AON and second AON of the compounds of the invention represented by SEQ ID NO: 16336-TEG-16515, 16335-TEG-16514, 16338-HEG-16517 and 16337-HEG-16516. The AONs were synthesized in 5 μmol scale using either an OP-10 synthesizer (GE/ÄKTA Oligopilot) or a MerMade 12 Synthesizer (BioAutomation), through standard phosphoramidite protocols. The TEG and HEG linkers in the compounds with SEQ ID NO: 16336-TEG-16515, 16335-TEG-16514, 16338-HEG-16517 and 16337-HEG16516 were introduced using the corresponding phosphoramidite building blocks and standard synthesis protocols. The AONs were cleaved and deprotected in a two-step sequence (DEA followed by conc. NH$_4$OH treatment), purified by anion-exchange chromatography, desalted by size exclusion chromatography and lyophilized. Mass spectrometry confirmed the identity of all AONs, and purity (determined by UPLC-UV) was found acceptable for all AONs (>80%).

TABLE 3

| Sequence (5'-3') | SEQ ID NO |
|---|---|
| C*AAGGAAGAUGGC*AUUUC*T | 16353 |
| TC*AAGGAAGAUGGC*AUUUC*T | 16026 |
| GGUAAGUUC*UGUC*C*AAGC* | 15980 |
| TC*AAGGAAGAUGGC*AUUUC*T-TEG-GGUAAGUUC*UGUC*C*AAGC* | 16336-TEG-16515 |
| GGUAAGUUC*UGUC*C*AAGC*-TEG-TC*AAGGAAGAUGGC*AUUUC*T | 16335-TEG-16514 |
| TC*AAGGAAGAUGGC*AUUUC*T-HEG-GGUAAGUUC*UGUC*C*AAGC* | 16338-HEG-16517 |
| GGUAAGUUC*UGUC*C*AAGC*-HEG-TC*AAGGAAGAUGGC*AUUUC*T | 16337-HEG-16516 |

A = adenosine; G = guanine; U = uracil; T = thymine; C* = 5-methylcytosine; G, A, C, T = LNA nucleotides;
TEG = tri-ethylene glycol linker, and HEG = hexa-ethylene glycol linker.

Gymnotic Uptake and cDNA Synthesis

Immortalized myoblasts, derived from a DMD patient with a deletion of exons 48 to 50, were cultured to confluency in 12-wells plates. To induce the formation of myotubes, proliferation medium was replaced by low-serum differentiation medium for 6 days, supplemented with 400 or 800 nM of AON (N=6) according to non-GLP standard operating procedures. Total RNA was then isolated and 1000 ng of RNA was used as input for the cDNA synthesis using random hexamer primers.

Digital Droplet (dd)PCR Analysis

Specific Taqman minor groove binder (MGB) assays were designed to detect the dystrophin transcript products with and without exon 51 (Table 4) and were purchased from Applied Biosystems. Digital droplet PCR analysis was performed on 1 µl (for transcript without exon skip) or 4 µl (for transcript with exon skip) of cDNA in a 20 µl reaction volume using an annealing/extension temperature of 60° C. according to the manufacturer's instructions (BioRad). Data was presented as percentage exon skip [$N_O$ skipped/($N_O$ skipped+$N_O$ non-skipped)*100].

TABLE 4

| Assay | Target Exons | Sequences | | SEQ ID NO |
|---|---|---|---|---|
| DMD_47-52 | 47/52 | Forward primer | TGAAAATAAGCTCAAGCAGACAAATC | 9 |
| | | Reverse primer | GACGCCTCTGTTCCAAATCC | 10 |
| | | Probe | CAGTGGATAAAGGCAACA | 11 |
| DMD_51-52.2 | 51/52 | Forward primer | GTGATGGTGGGTGACCTTGAG | 12 |
| | | Reverse primer | GACGCCTCTGTTCCAAATCC | 10 |
| | | Probe | CAAGCAGAAGGCAACAA | 13 |

Results

Applying a mixture of AONs (represented by SEQ ID NO: 16353 and 15980; or SEQ ID NO: 16026 and 15980) targeting distinct sequence stretches in exon 51 resulted in higher exon 51 skipping levels (up to 24%) than with each of the individual AONs (represented by SEQ ID NO: 16353, 16026 or 15980); up to 5.7% for SEQ ID NO: 16026 at 800 nM) (FIG. 1). A mixture of AONs (represented by SEQ ID NO: 16353 and 16026) targeting the same sequence stretch in exon 51 did not enhance the exon 51 skipping efficiency (3.2%). Remarkably, applying AONs targeting distinct sequence stretches in exon 51 (represented by SEQ ID NO: 16026 and 15980) and being linked to each other by tri-ethylene or hexa-ethylene glycol linkers even higher exon 51 skipping levels were obtained (up to 81.6% for SEQ ID NO: 16335-TEG-16514) (FIG. 1). In this example, the compounds wherein an AON represented by SEQ ID NO: 15980 is linked to the 5' end of an AON represented by SEQ ID NO: 16026 were most efficient (compounds represented by SEQ ID NO: 16335-TEG-16514 and 16337-HEG-16516).

Example 2 (In Vivo)

Material and Methods
Mouse Experiment

This mouse experiment was carried out according to the National Institute of Health (NIH) guidelines for the care and use of laboratory animals. Del52hDMD/mdx mice (Leiden University Medical Center, Veltrop et al., 2018; PLoS ONE 13 (2):e0193289) were randomized into groups (n=10) taking into account baseline weight and male-female distribution. Mice received 1× weekly an intravenous tail vein injection with single antisense oligonucleotides represented by SEQ ID NO: 16026 or 15980 (at 2.7 or 8.1 µmol/kg), a mixture thereof (4.05 µmol/kg each), or with the linked AON compound represented by SEQ ID NO: 16338-HEG-16517 (at 2.7 µmol/kg), starting at 5-6 weeks of age for a total of 12 weeks. Ten days after the last AON injection the animals were sacrificed and tissue samples collected (after transcardial perfusion with PBS in order to remove blood from the tissues). Quadriceps muscle tissue samples were snap frozen and stored at −80° C.

RNA Isolation and cDNA Synthesis

Quadriceps muscle tissue samples were homogenized in 1 ml Nucleozol (Macherey Nagel) by grinding in a MagNa Lyser using Lysing Matrix D Tubes (MP Biomedicals). Total RNA was extracted from the homogenate based on the manufacturer's instructions. For cDNA synthesis 1000 ng of total RNA was used as input. cDNA was generated in 20 µl reactions using random hexamer primers and GoScript Reverse Transcriptase and an incubation of 40 minutes at 50° C.

Digital Droplet PCR Analysis

Specific Taqman minor groove binder (MGB) assays were designed (using Primer Express 3.0.1 software; Applied Biosystems) to detect the dystrophin transcript products with and without exon 51 (Table 4) and purchased from Applied Biosystems. Digital droplet PCR analysis was performed on 2 or 4 µl of cDNA in a 20 µl reaction volume using an annealing/extension temperature of 60° C. according to the manufacturer's instructions (BioRad). Data was presented as percentage exon skip [$N_O$ skipped/($N_O$ skipped+$N_O$ non-skipped)*100].

Results

Figure 2:
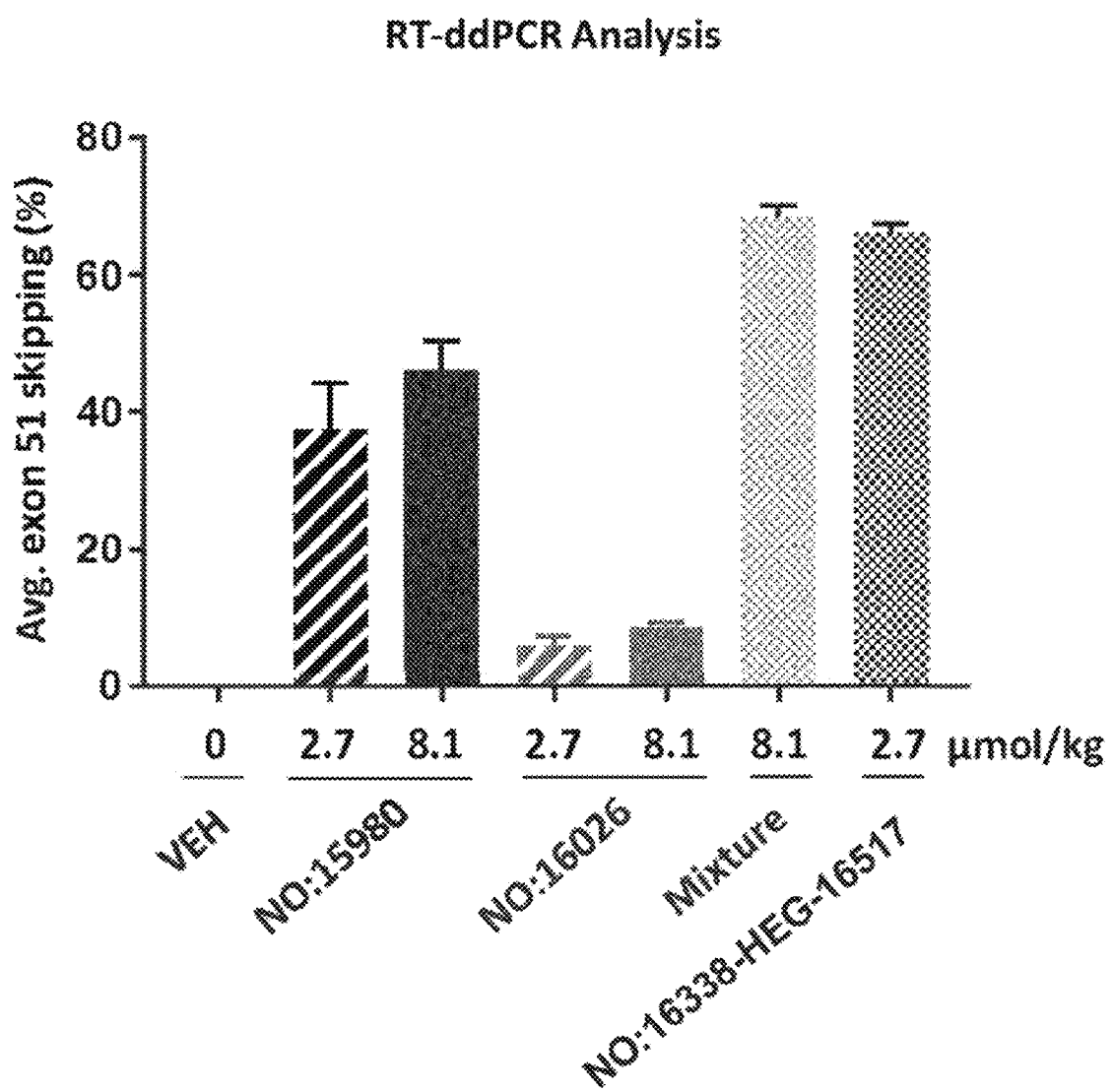
FIG. 2 is an RT-ddPCR analysis showing the synergistic effect of combining AONs with SEQ ID NO: 15980 and 16026, targeting distinct ESE sequence stretches, on exon 51 skipping efficiencies in quadriceps muscle from del52hDMD/mdx mice, especially if these AONs are linked by a linker such as HEG=hexa-ethylene glycol linker (compound represented by SEQ ID NO: 16338-HEG-16517). The skipping efficiency of the mixture of the AONs with SEQ ID NO: 15980 and 16026 at 4.05 μmol/kg each is higher than that of each of the single AONs at 8.1 μmol/kg. The molecule wherein these AONs were physically linked by HEG (compound represented by SEQ ID NO: 16338-HEG-16517) was even more efficient: at 2.7 μmol/kg similar to that of the mixture at 8.1 μmol/kg. Average exon 51 skipping percentages were determined based on RNA samples from 10 mice, error bars indicate standard deviation. VEH=vehicle.

The synergistic effect of combining AONs with SEQ ID NO: 15980 and 16026, targeting distinct ESE sequence stretches, on exon 51 skipping efficiencies is demonstrated in an in vivo study in del52hDMD/mdx mice. These mice are dystrophin-deficient, based on the mdx mutation in exon 23 of the murine DMD gene and an exon 52 deletion in the human DMD transgene on chromosome 5 (Veltrop et al. 2018). The effect is stronger if these AONs are linked by a linker such as HEG=hexa-ethylene glycol linker (compound represented by SEQ ID NO: 16338-HEG-16517) (FIG. 2). The skipping efficiency of the mixture of the AONs with SEQ ID NO: 15980 and 16026 at 4.05 µmol/kg each is higher than that of each of the single AONs at 8.1 µmol/kg. The molecule wherein these AONs were physically linked by HEG (compound represented by SEQ ID NO: 16338-HEG-16517) is even more efficient: at 2.7 µmol/kg similar to that of the mixture at 8.1 µmol/kg.

LIST OF REFERENCES

Aartsma-Rus et al., Hum Mol Gen 2003; 12(8):907-14.
Arai K et al. Bioorg. Med. Chem. 2011, 21, 6285
Baltimore, Md.: Lippincott Williams & Wilkins, 2000
Beekman et al., PLoS ONE 2014; 9(9): e107494
Beekman et al., PLoS ONE 2018; 13(4): e0195850
Bolli et al., Chem Biol. 1996 March; 3(3):197-206
Braida C., et al, Human Molecular Genetics, 2010, vol 9: 1399-1412

Bruno, K., Advanced Drug Delivery Reviews 2011; 63: 1210.
Cao et al., Mol. Ther. Nucleic Acids, 2016, doi:10.1038/mtna.2016.46
Cartegni L, et al, Nat Rev Genet 2002; 3(4):285-98.
Cartegni L, et al, Nucleic Acids Res 2003; 31(13):3568-71
Cirak et al., Lancet 2011; 378: 595-605.
Diebold S. S., et. al., Eur J Immunol. 2006; December; 36(12):3256-67.
Disterer et al., Mol Ther 2013, 21(3):602-609
doi: 10.1021/ja710342q
doi: 10.1093/nass/1.1.241
doi: 10.1021/jo100170g
DOI: 10.1021/jo402690j
doi: 10.1021/acs.joc.5b00184
Dominski and Kole, PNAS 1993, 90(18):8673-8677
Dorn and Kippenberger, Curr Opin Mol Ther 2008; 10(1): 10-20
Du et al., PNAS 2007, 104(14):6007-12
Ehmsen J. et al, J. Cell Sci. 2002, 115 (Pt14): 2801-2803.
Evers et al. PLoS ONE 2011, 6 (9) e24308
Evers et al., Nucleic Acid Ther 2014, 24(1):4-12
Fairbrother et al., Science 2002, 297(5583): 1007-1013
Fairbrother et al., Nucleic Acids 2004, 32: W187-190
Friedman et al., J Biol Chem 1999, 274(51):36193-36199
Gao et al., Cell Transplant 2008, 17(7):723-34
Gao et al., Mol Ther Nucleic Acids 2015, 4:e255
Gedicke-Hornung et al., EMBO Mol Med 2013, 5(7):1060-77
Giles et al., Antisense Nucleic Acid Drug Dev 1999, 9(2): 213-20
Goemans et al., N Engl J Med. 2011; 364(16):1513-22.
Goto et al., J Invest Dermatol 2006, 126(12):2614-20
Goyenvalle et al., Nat Med 2015, 21(3):270-5
Han et al., Nature Communications, 2016, doi:10.1038/ncomms10981
Hanessian et al., J. Org. Chem., 2013, 78 (18), pp 9064-9075
Heemskerk et al., Mol Ther 2010; 18(6):1210-7.
Hodgetts S., et al, Neuromuscular Disorders 2006; 16: 591-602
Hua et al., Am J Hum Genet 2008, 82(4): 834-48
Hua et al., Nature 2011, 478(7367):123-6
Karras et al., Biochemistry 2001, 40(26):7853-9
Khoo et al., BMC Mol Biol 2007, 8; 3 Krieg AM. et al., Nature 1995; 374: 546-549.
Krieg, A. M., Curr. Opin. Immunol. 2000; 12: 35-43.
Kumar L, Pharm. Technol. 2008, 3, 128
Lentz et al., Nat Med 2013, 19(3):345-350
Manzur A. Y. et al., Wiley publishers, 2008. The Cochrane collaboration.
Mercatante et al., J Biol Chem 2002, 277(51):49374-82
Monaco A. P., et al., Genomics 1988; 2: 90-95.
Murray et al., Nucl. Acids Res., 2012, Vol. 40, No. 13 6135-6143
Nishida et al. Chem. Commun. 2010, 46, 5283
Opalinska et al., Nucleic Acids Res., 2004, 32(19): 5791-5795
Osawa et al., J. Org. Chem., 2015, 80 (21), pp 10474-10481
Osorio et al., Sci Transl Med 2011, 3(106):106ra107
Owen et al., PLoS One 2012, 7(3):e33576
Peacey et al., NAR 2012, 40(19):9836-49
Peacock H et al. J. Am. Chem. Soc. 2011, 133, 9200
Popovic PJ. et al. J of Immunol 2006; 177: 8701-8707.
Remington: The Science and Practice of Pharmacy, 20th Edition.
Renshaw et al., Mol Cancer Ther 2004, 3(11):1467-84
Rincon et al., Am J Hum Genet 2007, 81(6):1262-1270
Seth et al., J. Org. Chem. 2010, 75, 1569-1581
Spitali et al., FASEB J 2013, 27(12): 4909-4916
Taniguchi-Ikeda et al., Nature 2011, 478(7367):127-31
Tyson-Capper et al., Mol Pharmacol 2006, 69(3):796-804
Uchikawa et al., J Hum Genet 2007, 52(11):891-897
Uehara et al., FASEB J 2013, 27(1):76-85
van Deutekom et al., N Engl J Med. 2007; 357(26):2677-86.
van Ommen, van Deutekom, Aartsma-Rus, Curr Opin Mol Ther. 2008; 10(2):140-9.
Veltrop et al., 2018; PLoS ONE 13(2):e0193289
Verheul et al., 2016; PLoS ONE 11(9):e0162467
Vetrini et al., Hum Mutat 2006, 27(5):420-6
Vickers et al., J Immunol 2006, 176(6):3652-61
Voit et al., Lancet Neurol 2014, 13(10):987-96
Wagner, H., Adv. Immunol. 1999; 73: 329-368.
Wein et al., Hum Mut 2010, 31(2):136-42
Wheeler et al., J Clin Invest 2007, 117(12):3952-7
Williams et al., Oligonucleotides 2006, 16(2):186-95
WO 2011/097641 (ISIS/Ionis Pharmaceuticals)
WO 2014/112463 (Obika S et al.)
WO 2014/126229 (Mitsuoka Y et al.)
WO 2014/145356 (MiRagen Therapeutics)
WO 2015/142910 (Ions Pharmaceuticals)
WO2016/017422 (Osaka University)
Yamamoto et al. Org. Biomol. Chem. 2015, 13, 3757
Yokota, Duddy, Partidge, Acta Myol. 2007; 26(3):179-84.
Straarup et al., 2010; Nucleic Acids Res 38(20): 7100-7111
Zammarchi et al., PNAS 2011, 108(43):17779-84
Zuker M., et al, Nucleic Acids Res. 2003; 31(13):3406-15.

SEQUENCE LISTING (16529 sequences)

SEQ ID NO: 1 - protein, 3685 aa, Homo sapiens
MLWWEEVEDCYEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSGLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVQETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 2 - RNA, 233 nt, Homo sapiens
  Exon 51
cuccuacucagacuguuacucuggugacacaaccugugguuacuaaggaaacugccaucuccaaacuagaaaugccaucuuccuugauguuggagguaccugcucuggcagauuucaaccgggcuuggacagaacuuaccgacuggcuuucucugcuugaucaaguuauaaaaucacagagggugauggugggugaccuugaggauaucaacgagaugaucaucaagcagaag

SEQ ID NO: 3 - RNA, 11 nt, Homo sapiens
  Exon Splicing Enhancer
ggacagaacuu

SEQ ID NO: 4 - RNA, 6 nt, Homo sapiens
  Exon Splicing Enhancer
aucuuc

SEQ ID NO: 5 - RNA, 11 nt, Homo sapiens
  Exon Splicing Enhancer
aaguucugucc

SEQ ID NO: 6 - RNA, 6 nt, Homo sapiens
  Exon Splicing Enhancer
gaagau

SEQ ID NO: 7 - RNA, 20 nt, Artificial Sequence
  Description of Artificial Sequence: Synthetic Drisapersen
ucaaggaagauggcauuucu

SEQ ID NO: 8 - DNA, 30 bp, Artificial Sequence
  Description of Artificial Sequence: Synthetic Eteplirsen
ctccaacatcaaggaagatggcatttctag

SEQ ID NO: 9 - DNA, 26 bp, Artificial Sequence
  Description of Artificial Sequence: Synthetic Primer
tgaaaataagctcaagcagacaaatc

SEQ ID NO: 10 - DNA, 20 bp, Artificial Sequence
  Description of Artificial Sequence: Synthetic Primer
gacgcctctgttccaaatcc

SEQ ID NO: 11 - DNA, 18 bp, Artificial Sequence
  Description of Artificial Sequence: Synthetic Primer
cagtggataaaggcaaca

SEQ ID NO: 12 - DNA, 21 bp, Artificial Sequence
  Description of Artificial Sequence: Synthetic Primer
gtgatggtgggtgaccttgag

SEQ ID NO: 13 - DNA, 17 bp, Artificial Sequence
  Description of Artificial Sequence: Synthetic Primer
caagcagaaggcaacaa

SEQ ID NO: 14 - RNA, 18 nt, Artificial Sequence
  Description of Artificial Sequence: Synthetic Antisense oligonucleotide
gguaaguucuguccaagc

SEQ ID NO: 15 - RNA, 18 nt, Artificial Sequence
  Description of Artificial Sequence: Synthetic Antisense oligonucleotide
guaaguucuguccaagcc

SEQ ID NO: 16 - RNA, 18 nt, Artificial Sequence
  Description of Artificial Sequence: Synthetic Antisense oligonucleotide
agucgguaaguucugucc

SEQ ID NO: 17 - RNA, 18 nt, Artificial Sequence
  Description of Artificial Sequence: Synthetic Antisense oligonucleotide
cuguccaagcccgguuga

SEQ ID NO: 18 - RNA, 15 nt, Artificial Sequence
  Description of Artificial Sequence: Synthetic Antisense oligonucleotide
uaaguucuguccaag

SEQ ID NO: 19 - RNA, 20 nt, Artificial Sequence
  Description of Artificial Sequence: Synthetic Antisense oligonucleotide
uucuguccaagcccgguuga

SEQ ID NO: 20 - RNA, 19 nt, Artificial Sequence
  Description of Artificial Sequence: Synthetic Antisense oligonucleotide
uucuguccaagcccgguug

SEQ ID NO: 21 - RNA, 18 nt, Artificial Sequence
  Description of Artificial Sequence: Synthetic Antisense oligonucleotide
uucuguccaagcccgguu

SEQ ID NO: 22 - RNA, 17 nt, Artificial Sequence
  Description of Artificial Sequence: Synthetic Antisense oligonucleotide
uucuguccaagcccggu

SEQ ID NO: 23 - RNA, 16 nt, Artificial Sequence
  Description of Artificial Sequence: Synthetic Antisense oligonucleotide
uucuguccaagcccgg

SEQ ID NO: 24 - RNA, 15 nt, Artificial Sequence
  Description of Artificial Sequence: Synthetic Antisense oligonucleotide
uucuguccaagcccg

SEQ ID NO: 25 - RNA, 14 nt, Artificial Sequence
  Description of Artificial Sequence: Synthetic Antisense oligonucleotide
uucuguccaagccc

SEQ ID NO: 26 - RNA, 13 nt, Artificial Sequence
  Description of Artificial Sequence: Synthetic Antisense oligonucleotide
uucuguccaagcc

SEQ ID NO: 27 - RNA, 12 nt, Artificial Sequence
  Description of Artificial Sequence: Synthetic Antisense oligonucleotide
uucuguccaagc

SEQ ID NO: 28 - RNA, 11 nt, Artificial Sequence
  Description of Artificial Sequence: Synthetic Antisense oligonucleotide
uucuguccaag

SEQ ID NO: 29 - RNA, 10 nt, Artificial Sequence
  Description of Artificial Sequence: Synthetic Antisense oligonucleotide
uucuguccaa

SEQ ID NO: 30 - RNA, 9 nt, Artificial Sequence
  Description of Artificial Sequence: Synthetic Antisense oligonucleotide
uucugucca

SEQ ID NO: 31 - RNA, 8 nt, Artificial Sequence
  Description of Artificial Sequence: Synthetic Antisense oligonucleotide
uucugucc

SEQ ID NO: 32 - RNA, 19 nt, Artificial Sequence
  Description of Artificial Sequence: Synthetic Antisense oligonucleotide
ucuguccaagcccgguuga

SEQ ID NO: 33 - RNA, 18 nt, Artificial Sequence
  Description of Artificial Sequence: Synthetic Antisense oligonucleotide
ucuguccaagcccgguug

SEQ ID NO: 34 - RNA, 17 nt, Artificial Sequence
  Description of Artificial Sequence: Synthetic Antisense oligonucleotide
ucuguccaagcccgguu

SEQ ID NO: 35 - RNA, 16 nt, Artificial Sequence
  Description of Artificial Sequence: Synthetic Antisense oligonucleotide
ucuguccaagcccggu

SEQ ID NO: 36 - RNA, 15 nt, Artificial Sequence
  Description of Artificial Sequence: Synthetic Antisense oligonucleotide
ucuguccaagcccgg

SEQ ID NO: 37 - RNA, 14 nt, Artificial Sequence
  Description of Artificial Sequence: Synthetic Antisense oligonucleotide
ucuguccaagcccg

SEQ ID NO: 38 - RNA, 13 nt, Artificial Sequence
  Description of Artificial Sequence: Synthetic Antisense oligonucleotide
ucuguccaagccc

SEQ ID NO: 39 - RNA, 12 nt, Artificial Sequence
  Description of Artificial Sequence: Synthetic Antisense oligonucleotide
ucuguccaagcc

SEQ ID NO: 40 - RNA, 11 nt, Artificial Sequence
  Description of Artificial Sequence: Synthetic Antisense oligonucleotide
ucuguccaagc

SEQ ID NO: 41 - RNA, 10 nt, Artificial Sequence
  Description of Artificial Sequence: Synthetic Antisense oligonucleotide
ucuguccaag

SEQ ID NO: 42 - RNA, 9 nt, Artificial Sequence
  Description of Artificial Sequence: Synthetic Antisense oligonucleotide
ucuguccaa

SEQ ID NO: 43 - RNA, 8 nt, Artificial Sequence
  Description of Artificial Sequence: Synthetic Antisense oligonucleotide
ucugucca

SEQ ID NO: 44 - RNA, 17 nt, Artificial Sequence
  Description of Artificial Sequence: Synthetic Antisense oligonucleotide
cuguccaagcccgguug

SEQ ID NO: 45 - RNA, 16 nt, Artificial Sequence
  Description of Artificial Sequence: Synthetic Antisense oligonucleotide
cuguccaagcccgguu

SEQ ID NO: 46 - RNA, 15 nt, Artificial Sequence
  Description of Artificial Sequence: Synthetic Antisense oligonucleotide
cuguccaagcccggu

SEQ ID NO: 47 - RNA, 14 nt, Artificial Sequence
  Description of Artificial Sequence: Synthetic Antisense oligonucleotide
cuguccaagcccgg

SEQ ID NO: 48 - RNA, 13 nt, Artificial Sequence
  Description of Artificial Sequence: Synthetic Antisense oligonucleotide
cuguccaagcccg

SEQ ID NO: 49 - RNA, 12 nt, Artificial Sequence
  Description of Artificial Sequence: Synthetic Antisense oligonucleotide
cuguccaagccc

SEQ ID NO: 50 - RNA, 11 nt, Artificial Sequence
  Description of Artificial Sequence: Synthetic Antisense oligonucleotide
cuguccaagcc

SEQ ID NO: 51 - RNA, 10 nt, Artificial Sequence
  Description of Artificial Sequence: Synthetic Antisense oligonucleotide
cuguccaagc

SEQ ID NO: 52 - RNA, 9 nt, Artificial Sequence
  Description of Artificial Sequence: Synthetic Antisense oligonucleotide
cuguccaag

SEQ ID NO: 53 - RNA, 8 nt, Artificial Sequence
  Description of Artificial Sequence: Synthetic Antisense oligonucleotide
cuguccaa

SEQ ID NO: 54 - RNA, 20 nt, Artificial Sequence
  Description of Artificial Sequence: Synthetic Antisense oligonucleotide
guucuguccaagcccgguug

SEQ ID NO: 55 - RNA, 19 nt, Artificial Sequence
  Description of Artificial Sequence: Synthetic Antisense oligonucleotide
guucuguccaagcccgguu

SEQ ID NO: 56 - RNA, 18 nt, Artificial Sequence
  Description of Artificial Sequence: Synthetic Antisense oligonucleotide
guucuguccaagcccggu

SEQ ID NO: 57 - RNA, 17 nt, Artificial Sequence
  Description of Artificial Sequence: Synthetic Antisense oligonucleotide
guucuguccaagcccgg

SEQ ID NO: 58 - RNA, 16 nt, Artificial Sequence
  Description of Artificial Sequence: Synthetic Antisense oligonucleotide
guucuguccaagcccg

SEQ ID NO: 59 - RNA, 15 nt, Artificial Sequence
  Description of Artificial Sequence: Synthetic Antisense oligonucleotide
guucuguccaagccc

SEQ ID NO: 60 - RNA, 14 nt, Artificial Sequence
  Description of Artificial Sequence: Synthetic Antisense oligonucleotide
guucuguccaagcc

SEQ ID NO: 61 - RNA, 13 nt, Artificial Sequence
  Description of Artificial Sequence: Synthetic Antisense oligonucleotide
guucuguccaagc

SEQ ID NO: 62 - RNA, 12 nt, Artificial Sequence
  Description of Artificial Sequence: Synthetic Antisense oligonucleotide
guucuguccaag

SEQ ID NO: 63 - RNA, 11 nt, Artificial Sequence
  Description of Artificial Sequence: Synthetic Antisense oligonucleotide
guucuguccaa

SEQ ID NO: 64 - RNA, 10 nt, Artificial Sequence
  Description of Artificial Sequence: Synthetic Antisense oligonucleotide
guucugucca

SEQ ID NO: 65 - RNA, 9 nt, Artificial Sequence
  Description of Artificial Sequence: Synthetic Antisense oligonucleotide
guucugucc

SEQ ID NO: 66 - RNA, 8 nt, Artificial Sequence
  Description of Artificial Sequence: Synthetic Antisense oligonucleotide
guucuguc

SEQ ID NO: 67 - RNA, 20 nt, Artificial Sequence
  Description of Artificial Sequence: Synthetic Antisense oligonucleotide
aguucuguccaagcccgguu

SEQ ID NO: 68 - RNA, 19 nt, Artificial Sequence
  Description of Artificial Sequence: Synthetic Antisense oligonucleotide
aguucuguccaagcccggu

SEQ ID NO: 69 - RNA, 18 nt, Artificial Sequence
  Description of Artificial Sequence: Synthetic Antisense oligonucleotide
aguucuguccaagcccgg

SEQ ID NO: 70 - RNA, 17 nt, Artificial Sequence
  Description of Artificial Sequence: Synthetic Antisense oligonucleotide
aguucuguccaagcccg

SEQ ID NO: 71 - RNA, 16 nt, Artificial Sequence
  Description of Artificial Sequence: Synthetic Antisense oligonucleotide
aguucuguccaagccc

SEQ ID NO: 72 - RNA, 15 nt, Artificial Sequence
  Description of Artificial Sequence: Synthetic Antisense oligonucleotide
aguucuguccaagcc

SEQ ID NO: 73 - RNA, 14 nt, Artificial Sequence
  Description of Artificial Sequence: Synthetic Antisense oligonucleotide
aguucuguccaagc

SEQ ID NO: 74 - RNA, 13 nt, Artificial Sequence
  Description of Artificial Sequence: Synthetic Antisense oligonucleotide
aguucuguccaag

SEQ ID NO: 75 - RNA, 12 nt, Artificial Sequence
  Description of Artificial Sequence: Synthetic Antisense oligonucleotide
aguucuguccaa

SEQ ID NO: 76 - RNA, 11 nt, Artificial Sequence
  Description of Artificial Sequence: Synthetic Antisense oligonucleotide
aguucugucca

SEQ ID NO: 77 - RNA, 10 nt, Artificial Sequence
  Description of Artificial Sequence: Synthetic Antisense oligonucleotide
aguucugucc

SEQ ID NO: 78 - RNA, 9 nt, Artificial Sequence
  Description of Artificial Sequence: Synthetic Antisense oligonucleotide
aguucuguc

SEQ ID NO: 79 - RNA, 8 nt, Artificial Sequence
  Description of Artificial Sequence: Synthetic Antisense oligonucleotide
aguucugu

SEQ ID NO: 80 - RNA, 20 nt, Artificial Sequence
  Description of Artificial Sequence: Synthetic Antisense oligonucleotide
aaguucuguccaagcccggu

SEQ ID NO: 81 - RNA, 19 nt, Artificial Sequence
  Description of Artificial Sequence: Synthetic Antisense oligonucleotide
aaguucuguccaagcccgg

SEQ ID NO: 82 - RNA, 18 nt, Artificial Sequence
  Description of Artificial Sequence: Synthetic Antisense oligonucleotide
aaguucuguccaagcccg

SEQ ID NO: 83 - RNA, 17 nt, Artificial Sequence
  Description of Artificial Sequence: Synthetic Antisense oligonucleotide
aaguucuguccaagccc

SEQ ID NO: 84 - RNA, 16 nt, Artificial Sequence
  Description of Artificial Sequence: Synthetic Antisense oligonucleotide
aaguucuguccaagcc

SEQ ID NO: 85 - RNA, 15 nt, Artificial Sequence
  Description of Artificial Sequence: Synthetic Antisense oligonucleotide
aaguucuguccaagc

SEQ ID NO: 86 - RNA, 14 nt, Artificial Sequence
  Description of Artificial Sequence: Synthetic Antisense oligonucleotide
aaguucuguccaag

SEQ ID NO: 87 - RNA, 13 nt, Artificial Sequence
  Description of Artificial Sequence: Synthetic Antisense oligonucleotide
aaguucuguccaa

SEQ ID NO: 88 - RNA, 12 nt, Artificial Sequence
  Description of Artificial Sequence: Synthetic Antisense oligonucleotide
aaguucugucca

SEQ ID NO: 89 - RNA, 11 nt, Artificial Sequence
  Description of Artificial Sequence: Synthetic Antisense oligonucleotide
aaguucugucc

SEQ ID NO: 90 - RNA, 10 nt, Artificial Sequence
  Description of Artificial Sequence: Synthetic Antisense oligonucleotide
aaguucuguc

SEQ ID NO: 91 - RNA, 9 nt, Artificial Sequence
  Description of Artificial Sequence: Synthetic Antisense oligonucleotide
aaguucugu

SEQ ID NO: 92 - RNA, 8 nt, Artificial Sequence
  Description of Artificial Sequence: Synthetic Antisense oligonucleotide
aaguucug

SEQ ID NO: 93 - RNA, 20 nt, Artificial Sequence
  Description of Artificial Sequence: Synthetic Antisense oligonucleotide
uaaguucuguccaagcccgg

SEQ ID NO: 94 - RNA, 19 nt, Artificial Sequence
  Description of Artificial Sequence: Synthetic Antisense oligonucleotide
uaaguucuguccaagcccg

SEQ ID NO: 95 - RNA, 18 nt, Artificial Sequence
  Description of Artificial Sequence: Synthetic Antisense oligonucleotide
uaaguucuguccaagccc

SEQ ID NO: 96 - RNA, 17 nt, Artificial Sequence
  Description of Artificial Sequence: Synthetic Antisense oligonucleotide
uaaguucuguccaagcc

SEQ ID NO: 97 - RNA, 16 nt, Artificial Sequence
  Description of Artificial Sequence: Synthetic Antisense oligonucleotide
uaaguucuguccaagc

SEQ ID NO: 98 - RNA, 14 nt, Artificial Sequence
  Description of Artificial Sequence: Synthetic Antisense oligonucleotide
uaaguucuguccaa

SEQ ID NO: 99 - RNA, 13 nt, Artificial Sequence
  Description of Artificial Sequence: Synthetic Antisense oligonucleotide
uaaguucugucca

SEQ ID NO: 100 - RNA, 12 nt, Artificial Sequence
  Description of Artificial Sequence: Synthetic Antisense oligonucleotide
uaaguucugucc

SEQ ID NO: 101 - RNA, 11 nt, Artificial Sequence
  Description of Artificial Sequence: Synthetic Antisense oligonucleotide
uaaguucuguc

SEQ ID NO: 102 - RNA, 10 nt, Artificial Sequence
  Description of Artificial Sequence: Synthetic Antisense oligonucleotide
uaaguucugu

SEQ ID NO: 103 - RNA, 9 nt, Artificial Sequence
  Description of Artificial Sequence: Synthetic Antisense oligonucleotide
uaaguucug

SEQ ID NO: 104 - RNA, 8 nt, Artificial Sequence
  Description of Artificial Sequence: Synthetic Antisense oligonucleotide
uaaguucu

SEQ ID NO: 105 - RNA, 20 nt, Artificial Sequence
  Description of Artificial Sequence: Synthetic Antisense oligonucleotide
guaaguucuguccaagcccg

SEQ ID NO: 106 - RNA, 19 nt, Artificial Sequence
  Description of Artificial Sequence: Synthetic Antisense oligonucleotide
guaaguucuguccaagccc

SEQ ID NO: 107 - RNA, 17 nt, Artificial Sequence
  Description of Artificial Sequence: Synthetic Antisense oligonucleotide
guaaguucuguccaagc

SEQ ID NO: 108 - RNA, 16 nt, Artificial Sequence
  Description of Artificial Sequence: Synthetic Antisense oligonucleotide
guaaguucuguccaag

SEQ ID NO: 109 - RNA, 15 nt, Artificial Sequence
  Description of Artificial Sequence: Synthetic Antisense oligonucleotide
guaaguucuguccaa

SEQ ID NO: 110 - RNA, 14 nt, Artificial Sequence
  Description of Artificial Sequence: Synthetic Antisense oligonucleotide
guaaguucugucca

SEQ ID NO: 111 - RNA, 13 nt, Artificial Sequence
  Description of Artificial Sequence: Synthetic Antisense oligonucleotide
guaaguucugucc

SEQ ID NO: 112 - RNA, 12 nt, Artificial Sequence
  Description of Artificial Sequence: Synthetic Antisense oligonucleotide
guaaguucuguc

SEQ ID NO: 113 - RNA, 11 nt, Artificial Sequence
  Description of Artificial Sequence: Synthetic Antisense oligonucleotide
guaaguucugu

SEQ ID NO: 114 - RNA, 10 nt, Artificial Sequence
  Description of Artificial Sequence: Synthetic Antisense oligonucleotide
guaaguucug

SEQ ID NO: 115 - RNA, 9 nt, Artificial Sequence
  Description of Artificial Sequence: Synthetic Antisense oligonucleotide
guaaguucu

SEQ ID NO: 116 - RNA, 8 nt, Artificial Sequence
  Description of Artificial Sequence: Synthetic Antisense oligonucleotide
guaaguuc

SEQ ID NO: 117 - RNA, 20 nt, Artificial Sequence
  Description of Artificial Sequence: Synthetic Antisense oligonucleotide
gguaaguucuguccaagccc

SEQ ID NO: 118 - RNA, 19 nt, Artificial Sequence
  Description of Artificial Sequence: Synthetic Antisense oligonucleotide
gguaaguucuguccaagcc

SEQ ID NO: 119 - RNA, 17 nt, Artificial Sequence
  Description of Artificial Sequence: Synthetic Antisense oligonucleotide
gguaaguucuguccaag

SEQ ID NO: 120 - RNA, 16 nt, Artificial Sequence
  Description of Artificial Sequence: Synthetic Antisense oligonucleotide
gguaaguucuguccaa

SEQ ID NO: 121 - RNA, 15 nt, Artificial Sequence
  Description of Artificial Sequence: Synthetic Antisense oligonucleotide
gguaaguucugucca

SEQ ID NO: 122 - RNA, 14 nt, Artificial Sequence
  Description of Artificial Sequence: Synthetic Antisense oligonucleotide
gguaaguucugucc

SEQ ID NO: 123 - RNA, 13 nt, Artificial Sequence
  Description of Artificial Sequence: Synthetic Antisense oligonucleotide
gguaaguucuguc

SEQ ID NO: 124 - RNA, 12 nt, Artificial Sequence
  Description of Artificial Sequence: Synthetic Antisense oligonucleotide
gguaaguucugu

SEQ ID NO: 125 - RNA, 11 nt, Artificial Sequence
  Description of Artificial Sequence: Synthetic Antisense oligonucleotide
gguaaguucug

SEQ ID NO: 126 - RNA, 10 nt, Artificial Sequence
  Description of Artificial Sequence: Synthetic Antisense oligonucleotide
gguaaguucu

SEQ ID NO: 127 - RNA, 9 nt, Artificial Sequence
  Description of Artificial Sequence: Synthetic Antisense oligonucleotide
gguaaguuc

SEQ ID NO: 128 - RNA, 8 nt, Artificial Sequence
  Description of Artificial Sequence: Synthetic Antisense oligonucleotide
gguaaguu

SEQ ID NO: 129 - RNA, 20 nt, Artificial Sequence
  Description of Artificial Sequence: Synthetic Antisense oligonucleotide
cgguaaguucuguccaagcc

SEQ ID NO: 130 - RNA, 19 nt, Artificial Sequence
  Description of Artificial Sequence: Synthetic Antisense oligonucleotide
cgguaaguucuguccaagc

SEQ ID NO: 131 - RNA, 18 nt, Artificial Sequence
  Description of Artificial Sequence: Synthetic Antisense oligonucleotide
cgguaaguucuguccaag

SEQ ID NO: 132 - RNA, 17 nt, Artificial Sequence
  Description of Artificial Sequence: Synthetic Antisense oligonucleotide
cgguaaguucuguccaa

SEQ ID NO: 133 - RNA, 16 nt, Artificial Sequence
  Description of Artificial Sequence: Synthetic Antisense oligonucleotide
cgguaaguucugucca

SEQ ID NO: 134 - RNA, 15 nt, Artificial Sequence
  Description of Artificial Sequence: Synthetic Antisense oligonucleotide
cgguaaguucugucc

SEQ ID NO: 135 - RNA, 14 nt, Artificial Sequence
  Description of Artificial Sequence: Synthetic Antisense oligonucleotide
cgguaaguucuguc

SEQ ID NO: 136 - RNA, 13 nt, Artificial Sequence
  Description of Artificial Sequence: Synthetic Antisense oligonucleotide
cgguaaguucugu

SEQ ID NO: 137 - RNA, 12 nt, Artificial Sequence
  Description of Artificial Sequence: Synthetic Antisense oligonucleotide
cgguaaguucug

SEQ ID NO: 138 - RNA, 11 nt, Artificial Sequence
  Description of Artificial Sequence: Synthetic Antisense oligonucleotide
cgguaaguucu

SEQ ID NO: 139 - RNA, 10 nt, Artificial Sequence
  Description of Artificial Sequence: Synthetic Antisense oligonucleotide
cgguaaguuc

SEQ ID NO: 140 - RNA, 9 nt, Artificial Sequence
  Description of Artificial Sequence: Synthetic Antisense oligonucleotide
cgguaaguu

SEQ ID NO: 141 - RNA, 8 nt, Artificial Sequence
  Description of Artificial Sequence: Synthetic Antisense oligonucleotide
cgguaagu

SEQ ID NO: 142 - RNA, 20 nt, Artificial Sequence
  Description of Artificial Sequence: Synthetic Antisense oligonucleotide
ucgguaaguucuguccaagc

SEQ ID NO: 143 - RNA, 19 nt, Artificial Sequence
  Description of Artificial Sequence: Synthetic Antisense oligonucleotide
ucgguaaguucuguccaag

SEQ ID NO: 144 - RNA, 18 nt, Artificial Sequence
  Description of Artificial Sequence: Synthetic Antisense oligonucleotide
ucgguaaguucuguccaa

SEQ ID NO: 145 - RNA, 17 nt, Artificial Sequence
  Description of Artificial Sequence: Synthetic Antisense oligonucleotide
ucgguaaguucugucca

SEQ ID NO: 146 - RNA, 16 nt, Artificial Sequence
  Description of Artificial Sequence: Synthetic Antisense oligonucleotide
ucgguaaguucugucc

SEQ ID NO: 147 - RNA, 15 nt, Artificial Sequence
  Description of Artificial Sequence: Synthetic Antisense oligonucleotide
ucgguaaguucuguc

SEQ ID NO: 148 - RNA, 14 nt, Artificial Sequence
  Description of Artificial Sequence: Synthetic Antisense oligonucleotide
ucgguaaguucugu

SEQ ID NO: 149 - RNA, 13 nt, Artificial Sequence
  Description of Artificial Sequence: Synthetic Antisense oligonucleotide
ucgguaaguucug

SEQ ID NO: 150 - RNA, 12 nt, Artificial Sequence
  Description of Artificial Sequence: Synthetic Antisense oligonucleotide
ucgguaaguucu

SEQ ID NO: 151 - RNA, 11 nt, Artificial Sequence
  Description of Artificial Sequence: Synthetic Antisense oligonucleotide
ucgguaaguuc

SEQ ID NO: 152 - RNA, 10 nt, Artificial Sequence
  Description of Artificial Sequence: Synthetic Antisense oligonucleotide
ucgguaaguu

SEQ ID NO: 153 - RNA, 9 nt, Artificial Sequence
  Description of Artificial Sequence: Synthetic Antisense oligonucleotide
ucgguaagu

SEQ ID NO: 154 - RNA, 20 nt, Artificial Sequence
  Description of Artificial Sequence: Synthetic Antisense oligonucleotide
gucgguaaguucuguccaag

SEQ ID NO: 155 - RNA, 19 nt, Artificial Sequence
  Description of Artificial Sequence: Synthetic Antisense oligonucleotide
gucgguaaguucuguccaa

SEQ ID NO: 156 - RNA, 18 nt, Artificial Sequence
  Description of Artificial Sequence: Synthetic Antisense oligonucleotide
gucgguaaguucugucca

SEQ ID NO: 157 - RNA, 17 nt, Artificial Sequence
  Description of Artificial Sequence: Synthetic Antisense oligonucleotide
gucgguaaguucugucc

SEQ ID NO: 158 - RNA, 16 nt, Artificial Sequence
  Description of Artificial Sequence: Synthetic Antisense oligonucleotide
gucgguaaguucuguc

SEQ ID NO: 159 - RNA, 15 nt, Artificial Sequence
  Description of Artificial Sequence: Synthetic Antisense oligonucleotide
gucgguaaguucugu

SEQ ID NO: 160 - RNA, 14 nt, Artificial Sequence
  Description of Artificial Sequence: Synthetic Antisense oligonucleotide
gucgguaaguucug

SEQ ID NO: 161 - RNA, 13 nt, Artificial Sequence
  Description of Artificial Sequence: Synthetic Antisense oligonucleotide
gucgguaaguucu

SEQ ID NO: 162 - RNA, 12 nt, Artificial Sequence
  Description of Artificial Sequence: Synthetic Antisense oligonucleotide
gucgguaaguuc

SEQ ID NO: 163 - RNA, 11 nt, Artificial Sequence
  Description of Artificial Sequence: Synthetic Antisense oligonucleotide
gucgguaaguu

SEQ ID NO: 164 - RNA, 10 nt, Artificial Sequence
  Description of Artificial Sequence: Synthetic Antisense oligonucleotide
gucgguaagu

SEQ ID NO: 165 - RNA, 20 nt, Artificial Sequence
  Description of Artificial Sequence: Synthetic Antisense oligonucleotide
agucgguaaguucuguccaa

SEQ ID NO: 166 - RNA, 19 nt, Artificial Sequence
  Description of Artificial Sequence: Synthetic Antisense oligonucleotide
agucgguaaguucugucca

SEQ ID NO: 167 - RNA, 17 nt, Artificial Sequence
  Description of Artificial Sequence: Synthetic Antisense oligonucleotide
agucgguaaguucuguc

SEQ ID NO: 168 - RNA, 16 nt, Artificial Sequence
  Description of Artificial Sequence: Synthetic Antisense oligonucleotide
agucgguaaguucugu

SEQ ID NO: 169 - RNA, 15 nt, Artificial Sequence
  Description of Artificial Sequence: Synthetic Antisense oligonucleotide
agucgguaaguucug

SEQ ID NO: 170 - RNA, 14 nt, Artificial Sequence
  Description of Artificial Sequence: Synthetic Antisense oligonucleotide
agucgguaaguucu

SEQ ID NO: 171 - RNA, 13 nt, Artificial Sequence
  Description of Artificial Sequence: Synthetic Antisense oligonucleotide
agucgguaaguuc

SEQ ID NO: 172 - RNA, 12 nt, Artificial Sequence
  Description of Artificial Sequence: Synthetic Antisense oligonucleotide
agucgguaaguu

SEQ ID NO: 173 - RNA, 11 nt, Artificial Sequence
  Description of Artificial Sequence: Synthetic Antisense oligonucleotide
agucgguaagu

SEQ ID NO: 174 - RNA, 20 nt, Artificial Sequence
  Description of Artificial Sequence: Synthetic Antisense oligonucleotide
cagucgguaaguucugucca

SEQ ID NO: 175 - RNA, 19 nt, Artificial Sequence
  Description of Artificial Sequence: Synthetic Antisense oligonucleotide
cagucgguaaguucugucc

SEQ ID NO: 176 - RNA, 18 nt, Artificial Sequence
  Description of Artificial Sequence: Synthetic Antisense oligonucleotide
cagucgguaaguucuguc

SEQ ID NO: 177 - RNA, 17 nt, Artificial Sequence
  Description of Artificial Sequence: Synthetic Antisense oligonucleotide
cagucgguaaguucugu

SEQ ID NO: 178 - RNA, 16 nt, Artificial Sequence
  Description of Artificial Sequence: Synthetic Antisense oligonucleotide
cagucgguaaguucug

SEQ ID NO: 179 - RNA, 15 nt, Artificial Sequence
  Description of Artificial Sequence: Synthetic Antisense oligonucleotide
cagucgguaaguucu

SEQ ID NO: 180 - RNA, 14 nt, Artificial Sequence
  Description of Artificial Sequence: Synthetic Antisense oligonucleotide
cagucgguaaguuc

SEQ ID NO: 181 - RNA, 13 nt, Artificial Sequence
  Description of Artificial Sequence: Synthetic Antisense oligonucleotide
cagucgguaaguu

SEQ ID NO: 182 - RNA, 12 nt, Artificial Sequence
  Description of Artificial Sequence: Synthetic Antisense oligonucleotide
cagucgguaagu

SEQ ID NO: 183 - RNA, 20 nt, Artificial Sequence
  Description of Artificial Sequence: Synthetic Antisense oligonucleotide
ccagucgguaaguucugucc

SEQ ID NO: 184 - RNA, 19 nt, Artificial Sequence
  Description of Artificial Sequence: Synthetic Antisense oligonucleotide
ccagucgguaaguucuguc

SEQ ID NO: 185 - RNA, 18 nt, Artificial Sequence
  Description of Artificial Sequence: Synthetic Antisense oligonucleotide
ccagucgguaaguucugu

SEQ ID NO: 186 - RNA, 17 nt, Artificial Sequence
  Description of Artificial Sequence: Synthetic Antisense oligonucleotide
ccagucgguaaguucug

SEQ ID NO: 187 - RNA, 16 nt, Artificial Sequence
  Description of Artificial Sequence: Synthetic Antisense oligonucleotide
ccagucgguaaguucu

SEQ ID NO: 188 - RNA, 15 nt, Artificial Sequence
  Description of Artificial Sequence: Synthetic Antisense oligonucleotide
ccagucgguaaguuc

SEQ ID NO: 189 - RNA, 14 nt, Artificial Sequence
  Description of Artificial Sequence: Synthetic Antisense oligonucleotide
ccagucgguaaguu

SEQ ID NO: 190 - RNA, 13 nt, Artificial Sequence
  Description of Artificial Sequence: Synthetic Antisense oligonucleotide
ccagucgguaagu

SEQ ID NO: 191 - RNA, 20 nt, Artificial Sequence
  Description of Artificial Sequence: Synthetic Antisense oligonucleotide
gccagucgguaaguucuguc

SEQ ID NO: 192 - RNA, 19 nt, Artificial Sequence
  Description of Artificial Sequence: Synthetic Antisense oligonucleotide
gccagucgguaaguucugu

SEQ ID NO: 193 - RNA, 18 nt, Artificial Sequence
  Description of Artificial Sequence: Synthetic Antisense oligonucleotide
gccagucgguaaguucug

SEQ ID NO: 194 - RNA, 17 nt, Artificial Sequence
  Description of Artificial Sequence: Synthetic Antisense oligonucleotide
gccagucgguaaguucu

SEQ ID NO: 195 - RNA, 16 nt, Artificial Sequence
  Description of Artificial Sequence: Synthetic Antisense oligonucleotide
gccagucgguaaguuc

SEQ ID NO: 196 - RNA, 15 nt, Artificial Sequence
  Description of Artificial Sequence: Synthetic Antisense oligonucleotide
gccagucgguaaguu

SEQ ID NO: 197 - RNA, 14 nt, Artificial Sequence
  Description of Artificial Sequence: Synthetic Antisense oligonucleotide
gccagucgguaagu

SEQ ID NO: 198 - RNA, 20 nt, Artificial Sequence
  Description of Artificial Sequence: Synthetic Antisense oligonucleotide
ucaaggaagauggcauuucu

SEQ ID NO: 199 - RNA, 22 nt, Artificial Sequence
  Description of Artificial Sequence: Synthetic Antisense oligonucleotide
ucaaggaagauggcauuucuag

SEQ ID NO: 200 - RNA, 16 nt, Artificial Sequence
  Description of Artificial Sequence: Synthetic Antisense oligonucleotide
ucaaggaagauggcau

SEQ ID NO: 201 - RNA, 15 nt, Artificial Sequence
  Description of Artificial Sequence: Synthetic Antisense oligonucleotide
gaagauggcauuucu

SEQ ID NO: 202 - RNA, 21 nt, Artificial Sequence
  Description of Artificial Sequence: Synthetic Antisense oligonucleotide
ucaaggaagauggcauuucua

SEQ ID NO: 203 - RNA, 19 nt, Artificial Sequence
  Description of Artificial Sequence: Synthetic Antisense oligonucleotide
ucaaggaagauggcauuuc

SEQ ID NO: 204 - RNA, 18 nt, Artificial Sequence
  Description of Artificial Sequence: Synthetic Antisense oligonucleotide
ucaaggaagauggcauuu

SEQ ID NO: 205 - RNA, 17 nt, Artificial Sequence
  Description of Artificial Sequence: Synthetic Antisense oligonucleotide
ucaaggaagauggcauu

SEQ ID NO: 206 - RNA, 15 nt, Artificial Sequence
  Description of Artificial Sequence: Synthetic Antisense oligonucleotide
ucaaggaagauggca

SEQ ID NO: 207 - RNA, 14 nt, Artificial Sequence
  Description of Artificial Sequence: Synthetic Antisense oligonucleotide
ucaaggaagauggc

SEQ ID NO: 208 - RNA, 13 nt, Artificial Sequence
  Description of Artificial Sequence: Synthetic Antisense oligonucleotide
ucaaggaagaugg

SEQ ID NO: 209 - RNA, 12 nt, Artificial Sequence
  Description of Artificial Sequence: Synthetic Antisense oligonucleotide
ucaaggaagaug

SEQ ID NO: 210 - RNA, 11 nt, Artificial Sequence
  Description of Artificial Sequence: Synthetic Antisense oligonucleotide
ucaaggaagau

SEQ ID NO: 211 - RNA, 10 nt, Artificial Sequence
  Description of Artificial Sequence: Synthetic Antisense oligonucleotide
ucaaggaaga

SEQ ID NO: 212 - RNA, 9 nt, Artificial Sequence
  Description of Artificial Sequence: Synthetic Antisense oligonucleotide
ucaaggaag

SEQ ID NO: 213 - RNA, 21 nt, Artificial Sequence
  Description of Artificial Sequence: Synthetic Antisense oligonucleotide
caaggaagauggcauuucuag

SEQ ID NO: 214 - RNA, 20 nt, Artificial Sequence
  Description of Artificial Sequence: Synthetic Antisense oligonucleotide
caaggaagauggcauuucua

SEQ ID NO: 215 - RNA, 19 nt, Artificial Sequence
  Description of Artificial Sequence: Synthetic Antisense oligonucleotide
caaggaagauggcauuucu

SEQ ID NO: 216 - RNA, 18 nt, Artificial Sequence
  Description of Artificial Sequence: Synthetic Antisense oligonucleotide
caaggaagauggcauuuc

SEQ ID NO: 217 - RNA, 17 nt, Artificial Sequence
  Description of Artificial Sequence: Synthetic Antisense oligonucleotide
caaggaagauggcauuu

SEQ ID NO: 218 - RNA, 16 nt, Artificial Sequence
  Description of Artificial Sequence: Synthetic Antisense oligonucleotide
caaggaagauggcauu

SEQ ID NO: 219 - RNA, 15 nt, Artificial Sequence
  Description of Artificial Sequence: Synthetic Antisense oligonucleotide
caaggaagauggcau

SEQ ID NO: 220 - RNA, 14 nt, Artificial Sequence
  Description of Artificial Sequence: Synthetic Antisense oligonucleotide
caaggaagauggca

SEQ ID NO: 221 - RNA, 13 nt, Artificial Sequence
  Description of Artificial Sequence: Synthetic Antisense oligonucleotide
caaggaagauggc

SEQ ID NO: 222 - RNA, 12 nt, Artificial Sequence
  Description of Artificial Sequence: Synthetic Antisense oligonucleotide
caaggaagaugg

SEQ ID NO: 223 - RNA, 11 nt, Artificial Sequence
  Description of Artificial Sequence: Synthetic Antisense oligonucleotide
caaggaagaug

SEQ ID NO: 224 - RNA, 10 nt, Artificial Sequence
  Description of Artificial Sequence: Synthetic Antisense oligonucleotide
caaggaagau

SEQ ID NO: 225 - RNA, 9 nt, Artificial Sequence
  Description of Artificial Sequence: Synthetic Antisense oligonucleotide
caaggaaga

SEQ ID NO: 226 - RNA, 8 nt, Artificial Sequence
  Description of Artificial Sequence: Synthetic Antisense oligonucleotide
caaggaag

SEQ ID NO: 227 - RNA, 20 nt, Artificial Sequence
  Description of Artificial Sequence: Synthetic Antisense oligonucleotide
aaggaagauggcauuucuag

SEQ ID NO: 228 - RNA, 19 nt, Artificial Sequence
  Description of Artificial Sequence: Synthetic Antisense oligonucleotide
aaggaagauggcauuucua

SEQ ID NO: 229 - RNA, 18 nt, Artificial Sequence
  Description of Artificial Sequence: Synthetic Antisense oligonucleotide
aaggaagauggcauuucu

SEQ ID NO: 230 - RNA, 17 nt, Artificial Sequence
  Description of Artificial Sequence: Synthetic Antisense oligonucleotide
aaggaagauggcauuuc

SEQ ID NO: 231 - RNA, 16 nt, Artificial Sequence
  Description of Artificial Sequence: Synthetic Antisense oligonucleotide
aaggaagauggcauuu

SEQ ID NO: 232 - RNA, 15 nt, Artificial Sequence
  Description of Artificial Sequence: Synthetic Antisense oligonucleotide
aaggaagauggcauu

SEQ ID NO: 233 - RNA, 14 nt, Artificial Sequence
  Description of Artificial Sequence: Synthetic Antisense oligonucleotide
aaggaagauggcau

SEQ ID NO: 234 - RNA, 13 nt, Artificial Sequence
  Description of Artificial Sequence: Synthetic Antisense oligonucleotide
aaggaagauggca

SEQ ID NO: 235 - RNA, 12 nt, Artificial Sequence
  Description of Artificial Sequence: Synthetic Antisense oligonucleotide
aaggaagauggc

SEQ ID NO: 236 - RNA, 11 nt, Artificial Sequence
  Description of Artificial Sequence: Synthetic Antisense oligonucleotide
aaggaagaugg

SEQ ID NO: 237 - RNA, 10 nt, Artificial Sequence
  Description of Artificial Sequence: Synthetic Antisense oligonucleotide
aaggaagaug

SEQ ID NO: 238 - RNA, 9 nt, Artificial Sequence
  Description of Artificial Sequence: Synthetic Antisense oligonucleotide
aaggaagau

SEQ ID NO: 239 - RNA, 8 nt, Artificial Sequence
  Description of Artificial Sequence: Synthetic Antisense oligonucleotide
aaggaaga

SEQ ID NO: 240 - RNA, 19 nt, Artificial Sequence
  Description of Artificial Sequence: Synthetic Antisense oligonucleotide
aggaagauggcauuucuag

SEQ ID NO: 241 - RNA, 18 nt, Artificial Sequence
  Description of Artificial Sequence: Synthetic Antisense oligonucleotide
aggaagauggcauuucua

SEQ ID NO: 242 - RNA, 17 nt, Artificial Sequence
  Description of Artificial Sequence: Synthetic Antisense oligonucleotide
aggaagauggcauuucu

SEQ ID NO: 243 - RNA, 16 nt, Artificial Sequence
  Description of Artificial Sequence: Synthetic Antisense oligonucleotide
aggaagauggcauuuc

SEQ ID NO: 244 - RNA, 15 nt, Artificial Sequence
  Description of Artificial Sequence: Synthetic Antisense oligonucleotide
aggaagauggcauuu

SEQ ID NO: 245 - RNA, 14 nt, Artificial Sequence
  Description of Artificial Sequence: Synthetic Antisense oligonucleotide
aggaagauggcauu

SEQ ID NO: 246 - RNA, 13 nt, Artificial Sequence
  Description of Artificial Sequence: Synthetic Antisense oligonucleotide
aggaagauggcau

SEQ ID NO: 247 - RNA, 12 nt, Artificial Sequence
  Description of Artificial Sequence: Synthetic Antisense oligonucleotide
aggaagauggca

SEQ ID NO: 248 - RNA, 10 nt, Artificial Sequence
  Description of Artificial Sequence: Synthetic Antisense oligonucleotide
aggaagaugg

SEQ ID NO: 249 - RNA, 9 nt, Artificial Sequence
  Description of Artificial Sequence: Synthetic Antisense oligonucleotide
aggaagaug

SEQ ID NO: 250 - RNA, 8 nt, Artificial Sequence
  Description of Artificial Sequence: Synthetic Antisense oligonucleotide
aggaagau

SEQ ID NO: 251 - RNA, 18 nt, Artificial Sequence
  Description of Artificial Sequence: Synthetic Antisense oligonucleotide
ggaagauggcauuucuag

SEQ ID NO: 252 - RNA, 17 nt, Artificial Sequence
  Description of Artificial Sequence: Synthetic Antisense oligonucleotide
ggaagauggcauuucua

SEQ ID NO: 253 - RNA, 16 nt, Artificial Sequence
  Description of Artificial Sequence: Synthetic Antisense oligonucleotide
ggaagauggcauuucu

SEQ ID NO: 254 - RNA, 15 nt, Artificial Sequence
  Description of Artificial Sequence: Synthetic Antisense oligonucleotide
ggaagauggcauuuc

SEQ ID NO: 255 - RNA, 14 nt, Artificial Sequence
  Description of Artificial Sequence: Synthetic Antisense oligonucleotide
ggaagauggcauuu

SEQ ID NO: 256 - RNA, 13 nt, Artificial Sequence
  Description of Artificial Sequence: Synthetic Antisense oligonucleotide
ggaagauggcauu

SEQ ID NO: 257 - RNA, 12 nt, Artificial Sequence
  Description of Artificial Sequence: Synthetic Antisense oligonucleotide
ggaagauggcau

SEQ ID NO: 258 - RNA, 11 nt, Artificial Sequence
  Description of Artificial Sequence: Synthetic Antisense oligonucleotide
ggaagauggca

SEQ ID NO: 259 - RNA, 10 nt, Artificial Sequence
  Description of Artificial Sequence: Synthetic Antisense oligonucleotide
ggaagauggc

SEQ ID NO: 260 - RNA, 8 nt, Artificial Sequence
  Description of Artificial Sequence: Synthetic Antisense oligonucleotide
ggaagaug

SEQ ID NO: 261 - RNA, 17 nt, Artificial Sequence
  Description of Artificial Sequence: Synthetic Antisense oligonucleotide
gaagauggcauuucuag

SEQ ID NO: 262 - RNA, 16 nt, Artificial Sequence
  Description of Artificial Sequence: Synthetic Antisense oligonucleotide
gaagauggcauuucua

SEQ ID NO: 263 - RNA, 14 nt, Artificial Sequence
  Description of Artificial Sequence: Synthetic Antisense oligonucleotide
gaagauggcauuuc

SEQ ID NO: 264 - RNA, 13 nt, Artificial Sequence
  Description of Artificial Sequence: Synthetic Antisense oligonucleotide
gaagauggcauuu

SEQ ID NO: 265 - RNA, 12 nt, Artificial Sequence
  Description of Artificial Sequence: Synthetic Antisense oligonucleotide
gaagauggcauu

SEQ ID NO: 266 - RNA, 11 nt, Artificial Sequence
  Description of Artificial Sequence: Synthetic Antisense oligonucleotide
gaagauggcau

SEQ ID NO: 267 - RNA, 10 nt, Artificial Sequence
  Description of Artificial Sequence: Synthetic Antisense oligonucleotide
gaagauggca

SEQ ID NO: 268 - RNA, 9 nt, Artificial Sequence
  Description of Artificial Sequence: Synthetic Antisense oligonucleotide
gaagauggc

SEQ ID NO: 269 - RNA, 8 nt, Artificial Sequence
  Description of Artificial Sequence: Synthetic Antisense oligonucleotide
gaagaugg

SEQ ID NO: 270 - RNA, 16 nt, Artificial Sequence
  Description of Artificial Sequence: Synthetic Antisense oligonucleotide
aagauggcauuucuag

SEQ ID NO: 271 - RNA, 15 nt, Artificial Sequence
  Description of Artificial Sequence: Synthetic Antisense oligonucleotide
aagauggcauuucua

SEQ ID NO: 272 - RNA, 14 nt, Artificial Sequence
  Description of Artificial Sequence: Synthetic Antisense oligonucleotide
aagauggcauuucu

SEQ ID NO: 273 - RNA, 13 nt, Artificial Sequence
  Description of Artificial Sequence: Synthetic Antisense oligonucleotide
aagauggcauuuc

SEQ ID NO: 274 - RNA, 12 nt, Artificial Sequence
  Description of Artificial Sequence: Synthetic Antisense oligonucleotide
aagauggcauuu

SEQ ID NO: 275 - RNA, 11 nt, Artificial Sequence
  Description of Artificial Sequence: Synthetic Antisense oligonucleotide
aagauggcauu

SEQ ID NO: 276 - RNA, 10 nt, Artificial Sequence
  Description of Artificial Sequence: Synthetic Antisense oligonucleotide
aagauggcau

SEQ ID NO: 277 - RNA, 9 nt, Artificial Sequence
  Description of Artificial Sequence: Synthetic Antisense oligonucleotide
aagauggca

SEQ ID NO: 278 - RNA, 8 nt, Artificial Sequence
  Description of Artificial Sequence: Synthetic Antisense oligonucleotide
aagauggc

SEQ ID NO: 279 - RNA, 15 nt, Artificial Sequence
  Description of Artificial Sequence: Synthetic Antisense oligonucleotide
agauggcauuucuag

SEQ ID NO: 280 - RNA, 14 nt, Artificial Sequence
  Description of Artificial Sequence: Synthetic Antisense oligonucleotide
agauggcauuucua

SEQ ID NO: 281 - RNA, 13 nt, Artificial Sequence
  Description of Artificial Sequence: Synthetic Antisense oligonucleotide
agauggcauuucu

SEQ ID NO: 282 - RNA, 12 nt, Artificial Sequence
  Description of Artificial Sequence: Synthetic Antisense oligonucleotide
agauggcauuuc

SEQ ID NO: 283 - RNA, 11 nt, Artificial Sequence
  Description of Artificial Sequence: Synthetic Antisense oligonucleotide
agauggcauuu

SEQ ID NO: 284 - RNA, 10 nt, Artificial Sequence
  Description of Artificial Sequence: Synthetic Antisense oligonucleotide
agauggcauu

SEQ ID NO: 285 - RNA, 9 nt, Artificial Sequence
  Description of Artificial Sequence: Synthetic Antisense oligonucleotide
agauggcau

SEQ ID NO: 286 - RNA, 8 nt, Artificial Sequence
  Description of Artificial Sequence: Synthetic Antisense oligonucleotide
agauggca

SEQ ID NO: 287 - RNA, 30 nt, Artificial Sequence
  Description of Artificial Sequence: Synthetic Antisense oligonucleotide
cuccaacaucaaggaagauggcauuucuag

SEQ ID NO: 288 - RNA, 29 nt, Artificial Sequence
  Description of Artificial Sequence: Synthetic Antisense oligonucleotide
cuccaacaucaaggaagauggcauuucua

SEQ ID NO: 289 - RNA, 28 nt, Artificial Sequence
  Description of Artificial Sequence: Synthetic Antisense oligonucleotide
cuccaacaucaaggaagauggcauuucu

SEQ ID NO: 290 - RNA, 27 nt, Artificial Sequence
  Description of Artificial Sequence: Synthetic Antisense oligonucleotide
cuccaacaucaaggaagauggcauuuc

SEQ ID NO: 291 - RNA, 26 nt, Artificial Sequence
  Description of Artificial Sequence: Synthetic Antisense oligonucleotide
cuccaacaucaaggaagauggcauuu

SEQ ID NO: 292 - RNA, 25 nt, Artificial Sequence
  Description of Artificial Sequence: Synthetic Antisense oligonucleotide
cuccaacaucaaggaagauggcauu

SEQ ID NO: 293 - RNA, 24 nt, Artificial Sequence
  Description of Artificial Sequence: Synthetic Antisense oligonucleotide
cuccaacaucaaggaagauggcau

SEQ ID NO: 294 - RNA, 23 nt, Artificial Sequence
  Description of Artificial Sequence: Synthetic Antisense oligonucleotide
cuccaacaucaaggaagauggca

SEQ ID NO: 295 - RNA, 22 nt, Artificial Sequence
  Description of Artificial Sequence: Synthetic Antisense oligonucleotide
cuccaacaucaaggaagauggc

SEQ ID NO: 296 - RNA, 21 nt, Artificial Sequence
  Description of Artificial Sequence: Synthetic Antisense oligonucleotide
cuccaacaucaaggaagaugg

SEQ ID NO: 297 - RNA, 20 nt, Artificial Sequence
  Description of Artificial Sequence: Synthetic Antisense oligonucleotide
cuccaacaucaaggaagaug

SEQ ID NO: 298 - RNA, 19 nt, Artificial Sequence
  Description of Artificial Sequence: Synthetic Antisense oligonucleotide
cuccaacaucaaggaagau

SEQ ID NO: 299 - RNA, 18 nt, Artificial Sequence
  Description of Artificial Sequence: Synthetic Antisense oligonucleotide
cuccaacaucaaggaaga

SEQ ID NO: 300 - RNA, 17 nt, Artificial Sequence
  Description of Artificial Sequence: Synthetic Antisense oligonucleotide
cuccaacaucaaggaag

SEQ ID NO: 301 - RNA, 29 nt, Artificial Sequence
  Description of Artificial Sequence: Synthetic Antisense oligonucleotide
uccaacaucaaggaagauggcauuucuag

SEQ ID NO: 302 - RNA, 28 nt, Artificial Sequence
  Description of Artificial Sequence: Synthetic Antisense oligonucleotide
uccaacaucaaggaagauggcauuucua

SEQ ID NO: 303 - RNA, 27 nt, Artificial Sequence
  Description of Artificial Sequence: Synthetic Antisense oligonucleotide
uccaacaucaaggaagauggcauuucu

SEQ ID NO: 304 - RNA, 26 nt, Artificial Sequence
  Description of Artificial Sequence: Synthetic Antisense oligonucleotide
uccaacaucaaggaagauggcauuuc

SEQ ID NO: 305 - RNA, 25 nt, Artificial Sequence
  Description of Artificial Sequence: Synthetic Antisense oligonucleotide
uccaacaucaaggaagauggcauuu

SEQ ID NO: 306 - RNA, 24 nt, Artificial Sequence
  Description of Artificial Sequence: Synthetic Antisense oligonucleotide
uccaacaucaaggaagauggcauu

SEQ ID NO: 307 - RNA, 23 nt, Artificial Sequence
  Description of Artificial Sequence: Synthetic Antisense oligonucleotide
uccaacaucaaggaagauggcau

SEQ ID NO: 308 - RNA, 22 nt, Artificial Sequence
  Description of Artificial Sequence: Synthetic Antisense oligonucleotide
uccaacaucaaggaagauggca

SEQ ID NO: 309 - RNA, 21 nt, Artificial Sequence
  Description of Artificial Sequence: Synthetic Antisense oligonucleotide
uccaacaucaaggaagauggc

SEQ ID NO: 310 - RNA, 20 nt, Artificial Sequence
  Description of Artificial Sequence: Synthetic Antisense oligonucleotide
uccaacaucaaggaagaugg

SEQ ID NO: 311 - RNA, 19 nt, Artificial Sequence
  Description of Artificial Sequence: Synthetic Antisense oligonucleotide
uccaacaucaaggaagaug

SEQ ID NO: 312 - RNA, 18 nt, Artificial Sequence
  Description of Artificial Sequence: Synthetic Antisense oligonucleotide
uccaacaucaaggaagau

SEQ ID NO: 313 - RNA, 17 nt, Artificial Sequence
  Description of Artificial Sequence: Synthetic Antisense oligonucleotide
uccaacaucaaggaaga

SEQ ID NO: 314 - RNA, 16 nt, Artificial Sequence
  Description of Artificial Sequence: Synthetic Antisense oligonucleotide
uccaacaucaaggaag

SEQ ID NO: 315 - RNA, 28 nt, Artificial Sequence
  Description of Artificial Sequence: Synthetic Antisense oligonucleotide
ccaacaucaaggaagauggcauuucuag

SEQ ID NO: 316 - RNA, 27 nt, Artificial Sequence
  Description of Artificial Sequence: Synthetic Antisense oligonucleotide
ccaacaucaaggaagauggcauuucua

SEQ ID NO: 317 - RNA, 26 nt, Artificial Sequence
  Description of Artificial Sequence: Synthetic Antisense oligonucleotide
ccaacaucaaggaagauggcauuucu

SEQ ID NO: 318 - RNA, 25 nt, Artificial Sequence
  Description of Artificial Sequence: Synthetic Antisense oligonucleotide
ccaacaucaaggaagauggcauuuc

SEQ ID NO: 319 - RNA, 24 nt, Artificial Sequence
  Description of Artificial Sequence: Synthetic Antisense oligonucleotide
ccaacaucaaggaagauggcauuu

SEQ ID NO: 320 - RNA, 23 nt, Artificial Sequence
  Description of Artificial Sequence: Synthetic Antisense oligonucleotide
ccaacaucaaggaagauggcauu

SEQ ID NO: 321 - RNA, 22 nt, Artificial Sequence
  Description of Artificial Sequence: Synthetic Antisense oligonucleotide
ccaacaucaaggaagauggcau

SEQ ID NO: 322 - RNA, 21 nt, Artificial Sequence
  Description of Artificial Sequence: Synthetic Antisense oligonucleotide
ccaacaucaaggaagauggca

SEQ ID NO: 323 - RNA, 20 nt, Artificial Sequence
  Description of Artificial Sequence: Synthetic Antisense oligonucleotide
ccaacaucaaggaagauggc

SEQ ID NO: 324 - RNA, 19 nt, Artificial Sequence
  Description of Artificial Sequence: Synthetic Antisense oligonucleotide
ccaacaucaaggaagaugg

SEQ ID NO: 325 - RNA, 18 nt, Artificial Sequence
  Description of Artificial Sequence: Synthetic Antisense oligonucleotide
ccaacaucaaggaagaug

SEQ ID NO: 326 - RNA, 17 nt, Artificial Sequence
  Description of Artificial Sequence: Synthetic Antisense oligonucleotide
ccaacaucaaggaagau

SEQ ID NO: 327 - RNA, 16 nt, Artificial Sequence
  Description of Artificial Sequence: Synthetic Antisense oligonucleotide
ccaacaucaaggaaga

SEQ ID NO: 328 - RNA, 15 nt, Artificial Sequence
  Description of Artificial Sequence: Synthetic Antisense oligonucleotide
ccaacaucaaggaag

SEQ ID NO: 329 - RNA, 27 nt, Artificial Sequence
  Description of Artificial Sequence: Synthetic Antisense oligonucleotide
caacaucaaggaagauggcauuucuag

SEQ ID NO: 330 - RNA, 26 nt, Artificial Sequence
  Description of Artificial Sequence: Synthetic Antisense oligonucleotide
caacaucaaggaagauggcauuucua

SEQ ID NO: 331 - RNA, 25 nt, Artificial Sequence
  Description of Artificial Sequence: Synthetic Antisense oligonucleotide
caacaucaaggaagauggcauuucu

SEQ ID NO: 332 - RNA, 24 nt, Artificial Sequence
  Description of Artificial Sequence: Synthetic Antisense oligonucleotide
caacaucaaggaagauggcauuuc

SEQ ID NO: 333 - RNA, 23 nt, Artificial Sequence
  Description of Artificial Sequence: Synthetic Antisense oligonucleotide
caacaucaaggaagauggcauuu

SEQ ID NO: 334 - RNA, 22 nt, Artificial Sequence
  Description of Artificial Sequence: Synthetic Antisense oligonucleotide
caacaucaaggaagauggcauu

SEQ ID NO: 335 - RNA, 21 nt, Artificial Sequence
  Description of Artificial Sequence: Synthetic Antisense oligonucleotide
caacaucaaggaagauggcau

SEQ ID NO: 336 - RNA, 20 nt, Artificial Sequence
  Description of Artificial Sequence: Synthetic Antisense oligonucleotide
caacaucaaggaagauggca

SEQ ID NO: 337 - RNA, 19 nt, Artificial Sequence
  Description of Artificial Sequence: Synthetic Antisense oligonucleotide
caacaucaaggaagauggc

SEQ ID NO: 338 - RNA, 18 nt, Artificial Sequence
  Description of Artificial Sequence: Synthetic Antisense oligonucleotide
caacaucaaggaagaugg

SEQ ID NO: 339 - RNA, 17 nt, Artificial Sequence
  Description of Artificial Sequence: Synthetic Antisense oligonucleotide
caacaucaaggaagaug

SEQ ID NO: 340 - RNA, 16 nt, Artificial Sequence
  Description of Artificial Sequence: Synthetic Antisense oligonucleotide
caacaucaaggaagau

SEQ ID NO: 341 - RNA, 15 nt, Artificial Sequence
  Description of Artificial Sequence: Synthetic Antisense oligonucleotide
caacaucaaggaaga

SEQ ID NO: 342 - RNA, 14 nt, Artificial Sequence
  Description of Artificial Sequence: Synthetic Antisense oligonucleotide
caacaucaaggaag

SEQ ID NO: 343 - RNA, 26 nt, Artificial Sequence
  Description of Artificial Sequence: Synthetic Antisense oligonucleotide
aacaucaaggaagauggcauuucuag

SEQ ID NO: 344 - RNA, 25 nt, Artificial Sequence
  Description of Artificial Sequence: Synthetic Antisense oligonucleotide
aacaucaaggaagauggcauuucua

SEQ ID NO: 345 - RNA, 24 nt, Artificial Sequence
  Description of Artificial Sequence: Synthetic Antisense oligonucleotide
aacaucaaggaagauggcauuucu

SEQ ID NO: 346 - RNA, 23 nt, Artificial Sequence
  Description of Artificial Sequence: Synthetic Antisense oligonucleotide
aacaucaaggaagauggcauuuc

SEQ ID NO: 347 - RNA, 22 nt, Artificial Sequence
  Description of Artificial Sequence: Synthetic Antisense oligonucleotide
aacaucaaggaagauggcauuu

SEQ ID NO: 348 - RNA, 21 nt, Artificial Sequence
  Description of Artificial Sequence: Synthetic Antisense oligonucleotide
aacaucaaggaagauggcauu

SEQ ID NO: 349 - RNA, 20 nt, Artificial Sequence
  Description of Artificial Sequence: Synthetic Antisense oligonucleotide
aacaucaaggaagauggcau

SEQ ID NO: 350 - RNA, 19 nt, Artificial Sequence
  Description of Artificial Sequence: Synthetic Antisense oligonucleotide
aacaucaaggaagauggca

SEQ ID NO: 351 - RNA, 18 nt, Artificial Sequence
  Description of Artificial Sequence: Synthetic Antisense oligonucleotide
aacaucaaggaagauggc

SEQ ID NO: 352 - RNA, 17 nt, Artificial Sequence
  Description of Artificial Sequence: Synthetic Antisense oligonucleotide
aacaucaaggaagaugg

SEQ ID NO: 353 - RNA, 16 nt, Artificial Sequence
  Description of Artificial Sequence: Synthetic Antisense oligonucleotide
aacaucaaggaagaug

SEQ ID NO: 354 - RNA, 15 nt, Artificial Sequence
  Description of Artificial Sequence: Synthetic Antisense oligonucleotide
aacaucaaggaagau

SEQ ID NO: 355 - RNA, 14 nt, Artificial Sequence
  Description of Artificial Sequence: Synthetic Antisense oligonucleotide
aacaucaaggaaga

SEQ ID NO: 356 - RNA, 13 nt, Artificial Sequence
  Description of Artificial Sequence: Synthetic Antisense oligonucleotide
aacaucaaggaag

SEQ ID NO: 357 - RNA, 25 nt, Artificial Sequence
  Description of Artificial Sequence: Synthetic Antisense oligonucleotide
acaucaaggaagauggcauuucuag

SEQ ID NO: 358 - RNA, 24 nt, Artificial Sequence
  Description of Artificial Sequence: Synthetic Antisense oligonucleotide
acaucaaggaagauggcauuucua

SEQ ID NO: 359 - RNA, 23 nt, Artificial Sequence
  Description of Artificial Sequence: Synthetic Antisense oligonucleotide
acaucaaggaagauggcauuucu

SEQ ID NO: 360 - RNA, 22 nt, Artificial Sequence
  Description of Artificial Sequence: Synthetic Antisense oligonucleotide
acaucaaggaagauggcauuuc

SEQ ID NO: 361 - RNA, 21 nt, Artificial Sequence
  Description of Artificial Sequence: Synthetic Antisense oligonucleotide
acaucaaggaagauggcauuu

SEQ ID NO: 362 - RNA, 20 nt, Artificial Sequence
  Description of Artificial Sequence: Synthetic Antisense oligonucleotide
acaucaaggaagauggcauu

SEQ ID NO: 363 - RNA, 19 nt, Artificial Sequence
  Description of Artificial Sequence: Synthetic Antisense oligonucleotide
acaucaaggaagauggcau

SEQ ID NO: 364 - RNA, 18 nt, Artificial Sequence
  Description of Artificial Sequence: Synthetic Antisense oligonucleotide
acaucaaggaagauggca

SEQ ID NO: 365 - RNA, 17 nt, Artificial Sequence
  Description of Artificial Sequence: Synthetic Antisense oligonucleotide
acaucaaggaagauggc

SEQ ID NO: 366 - RNA, 16 nt, Artificial Sequence
  Description of Artificial Sequence: Synthetic Antisense oligonucleotide
acaucaaggaagaugg

SEQ ID NO: 367 - RNA, 15 nt, Artificial Sequence
  Description of Artificial Sequence: Synthetic Antisense oligonucleotide
acaucaaggaagaug

SEQ ID NO: 368 - RNA, 14 nt, Artificial Sequence
  Description of Artificial Sequence: Synthetic Antisense oligonucleotide
acaucaaggaagau

SEQ ID NO: 369 - RNA, 13 nt, Artificial Sequence
  Description of Artificial Sequence: Synthetic Antisense oligonucleotide
acaucaaggaaga

SEQ ID NO: 370 - RNA, 12 nt, Artificial Sequence
  Description of Artificial Sequence: Synthetic Antisense oligonucleotide
acaucaaggaag

SEQ ID NO: 371 - RNA, 24 nt, Artificial Sequence
  Description of Artificial Sequence: Synthetic Antisense oligonucleotide
caucaaggaagauggcauuucuag

SEQ ID NO: 372 - RNA, 23 nt, Artificial Sequence
  Description of Artificial Sequence: Synthetic Antisense oligonucleotide
caucaaggaagauggcauuucua

SEQ ID NO: 373 - RNA, 22 nt, Artificial Sequence
  Description of Artificial Sequence: Synthetic Antisense oligonucleotide
caucaaggaagauggcauuucu

SEQ ID NO: 374 - RNA, 21 nt, Artificial Sequence
  Description of Artificial Sequence: Synthetic Antisense oligonucleotide
caucaaggaagauggcauuuc

SEQ ID NO: 375 - RNA, 20 nt, Artificial Sequence
  Description of Artificial Sequence: Synthetic Antisense oligonucleotide
caucaaggaagauggcauuu

SEQ ID NO: 376 - RNA, 19 nt, Artificial Sequence
  Description of Artificial Sequence: Synthetic Antisense oligonucleotide
caucaaggaagauggcauu

SEQ ID NO: 377 - RNA, 18 nt, Artificial Sequence
  Description of Artificial Sequence: Synthetic Antisense oligonucleotide
caucaaggaagauggcau

SEQ ID NO: 378 - RNA, 17 nt, Artificial Sequence
  Description of Artificial Sequence: Synthetic Antisense oligonucleotide
caucaaggaagauggca

SEQ ID NO: 379 - RNA, 16 nt, Artificial Sequence
  Description of Artificial Sequence: Synthetic Antisense oligonucleotide
caucaaggaagauggc

SEQ ID NO: 380 - RNA, 15 nt, Artificial Sequence
  Description of Artificial Sequence: Synthetic Antisense oligonucleotide
caucaaggaagaugg

SEQ ID NO: 381 - RNA, 14 nt, Artificial Sequence
  Description of Artificial Sequence: Synthetic Antisense oligonucleotide
caucaaggaagaug

SEQ ID NO: 382 - RNA, 13 nt, Artificial Sequence
  Description of Artificial Sequence: Synthetic Antisense oligonucleotide
caucaaggaagau

SEQ ID NO: 383 - RNA, 12 nt, Artificial Sequence
  Description of Artificial Sequence: Synthetic Antisense oligonucleotide
caucaaggaaga

SEQ ID NO: 384 - RNA, 11 nt, Artificial Sequence
  Description of Artificial Sequence: Synthetic Antisense oligonucleotide
caucaaggaag

SEQ ID NO: 385 - RNA, 23 nt, Artificial Sequence
  Description of Artificial Sequence: Synthetic Antisense oligonucleotide
aucaaggaagauggcauuucuag

SEQ ID NO: 386 - RNA, 22 nt, Artificial Sequence
  Description of Artificial Sequence: Synthetic Antisense oligonucleotide
aucaaggaagauggcauuucua

SEQ ID NO: 387 - RNA, 21 nt, Artificial Sequence
  Description of Artificial Sequence: Synthetic Antisense oligonucleotide
aucaaggaagauggcauuucu

SEQ ID NO: 388 - RNA, 20 nt, Artificial Sequence
  Description of Artificial Sequence: Synthetic Antisense oligonucleotide
aucaaggaagauggcauuuc

SEQ ID NO: 389 - RNA, 19 nt, Artificial Sequence
  Description of Artificial Sequence: Synthetic Antisense oligonucleotide
aucaaggaagauggcauuu

SEQ ID NO: 390 - RNA, 18 nt, Artificial Sequence
  Description of Artificial Sequence: Synthetic Antisense oligonucleotide
aucaaggaagauggcauu

SEQ ID NO: 391 - RNA, 17 nt, Artificial Sequence
  Description of Artificial Sequence: Synthetic Antisense oligonucleotide
aucaaggaagauggcau

SEQ ID NO: 392 - RNA, 16 nt, Artificial Sequence
  Description of Artificial Sequence: Synthetic Antisense oligonucleotide
aucaaggaagauggca

SEQ ID NO: 393 - RNA, 15 nt, Artificial Sequence
  Description of Artificial Sequence: Synthetic Antisense oligonucleotide
aucaaggaagauggc

SEQ ID NO: 394 - RNA, 14 nt, Artificial Sequence
  Description of Artificial Sequence: Synthetic Antisense oligonucleotide
aucaaggaagaugg

SEQ ID NO: 395 - RNA, 13 nt, Artificial Sequence
  Description of Artificial Sequence: Synthetic Antisense oligonucleotide
aucaaggaagaug

SEQ ID NO: 396 - RNA, 12 nt, Artificial Sequence
  Description of Artificial Sequence: Synthetic Antisense oligonucleotide
aucaaggaagau

SEQ ID NO: 397 - RNA, 11 nt, Artificial Sequence
  Description of Artificial Sequence: Synthetic Antisense oligonucleotide
aucaaggaaga

SEQ ID NO: 398 - RNA, 10 nt, Artificial Sequence
  Description of Artificial Sequence: Synthetic Antisense oligonucleotide
aucaaggaag

SEQ ID NO: 399 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
gguaaguucuguccaagc

SEQ ID NO: 400 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
guaaguucuguccaagcc

SEQ ID NO: 401 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agucgguaaguucugucc

SEQ ID NO: 402 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
cuguccaagcccgguuga

SEQ ID NO: 403 - RNA, 15 nt, Artificial Sequence
  Description of Artificial Sequence: Synthetic Antisense oligonucleotide
  misc_feature (7)..(7): 5-methyl
  misc_feature (11)..(12): 5-methyl
uaaguucuguccaag

SEQ ID NO: 404 - RNA, 20 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
uucuguccaagcccgguuga

SEQ ID NO: 405 - RNA, 19 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
uucuguccaagcccgguug

SEQ ID NO: 406 - RNA, 18 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
uucuguccaagcccgguu

SEQ ID NO: 407 - RNA, 17 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
uucuguccaagcccggu

SEQ ID NO: 408 - RNA, 16 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
uucuguccaagcccgg

SEQ ID NO: 409 - RNA, 15 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
uucuguccaagcccg

SEQ ID NO: 410 - RNA, 14 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
uucuguccaagccc

SEQ ID NO: 411 - RNA, 13 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(13): 5-methyl
uucuguccaagcc

SEQ ID NO: 412 - RNA, 12 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(12): 5-methyl
uucuguccaagc

SEQ ID NO: 413 - RNA, 11 nt, Artificial Sequence
  Description of Artificial Sequence: Synthetic Antisense oligonucleotide
  misc_feature (3)..(3): 5-methyl
  misc_feature (7)..(8): 5-methyl
uucuguccaag

SEQ ID NO: 414 - RNA, 10 nt, Artificial Sequence
  Description of Artificial Sequence: Synthetic Antisense oligonucleotide
  misc_feature (3)..(3): 5-methyl
  misc_feature (7)..(8): 5-methyl
uucuguccaa

SEQ ID NO: 415 - RNA, 9 nt, Artificial Sequence
  Description of Artificial Sequence: Synthetic Antisense oligonucleotide
  misc_feature (3)..(3): 5-methyl
  misc_feature (7)..(8): 5-methyl
uucugucca

SEQ ID NO: 416 - RNA, 8 nt, Artificial Sequence
  Description of Artificial Sequence: Synthetic Antisense oligonucleotide
  misc_feature (3)..(3): 5-methyl
  misc_feature (7)..(8): 5-methyl
uucugucc

SEQ ID NO: 417 - RNA, 19 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
ucuguccaagcccgguuga

SEQ ID NO: 418 - RNA, 18 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
ucuguccaagcccgguug

SEQ ID NO: 419 - RNA, 17 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
ucuguccaagcccgguu

SEQ ID NO: 420 - RNA, 16 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
ucuguccaagcccggu

SEQ ID NO: 421 - RNA, 15 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
ucuguccaagcccgg

SEQ ID NO: 422 - RNA, 14 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
ucuguccaagcccg

SEQ ID NO: 423 - RNA, 13 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
ucuguccaagccc

SEQ ID NO: 424 - RNA, 12 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(12): 5-methyl
ucuguccaagcc

SEQ ID NO: 425 - RNA, 11 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(11): 5-methyl
ucuguccaagc

SEQ ID NO: 426 - RNA, 10 nt, Artificial Sequence
  Description of Artificial Sequence: Synthetic Antisense oligonucleotide
  misc_feature (2)..(2): 5-methyl
  misc_feature (6)..(7): 5-methyl
ucuguccaag

SEQ ID NO: 427 - RNA, 9 nt, Artificial Sequence
  Description of Artificial Sequence: Synthetic Antisense oligonucleotide
  misc_feature (2)..(2): 5-methyl
  misc_feature (6)..(7): 5-methyl
ucuguccaa

SEQ ID NO: 428 - RNA, 8 nt, Artificial Sequence
  Description of Artificial Sequence: Synthetic Antisense oligonucleotide
  misc_feature (2)..(2): 5-methyl
  misc_feature (6)..(7): 5-methyl
ucugucca

SEQ ID NO: 429 - RNA, 17 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
cuguccaagcccgguug

SEQ ID NO: 430 - RNA, 16 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
cuguccaagcccgguu

SEQ ID NO: 431 - RNA, 15 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
cuguccaagcccggu

SEQ ID NO: 432 - RNA, 14 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
cuguccaagcccgg

SEQ ID NO: 433 - RNA, 13 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
cuguccaagcccg

SEQ ID NO: 434 - RNA, 12 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
cuguccaagccc

SEQ ID NO: 435 - RNA, 11 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(11): 5-methyl
cuguccaagcc

SEQ ID NO: 436 - RNA, 10 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(10): 5-methyl
cuguccaagc

SEQ ID NO: 437 - RNA, 9 nt, Artificial Sequence
  Description of Artificial Sequence: Synthetic Antisense oligonucleotide
  misc_feature (1)..(1): 5-methyl
  misc_feature (5)..(6): 5-methyl
cuguccaag

SEQ ID NO: 438 - RNA, 8 nt, Artificial Sequence
  Description of Artificial Sequence: Synthetic Antisense oligonucleotide
  misc_feature (1)..(1): 5-methyl
  misc_feature (5)..(6): 5-methyl
cuguccaa

SEQ ID NO: 439 - RNA, 20 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
guucuguccaagcccgguug

SEQ ID NO: 440 - RNA, 19 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
guucuguccaagcccgguu

SEQ ID NO: 441 - RNA, 18 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
guucuguccaagcccggu

SEQ ID NO: 442 - RNA, 17 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
guucuguccaagcccgg

SEQ ID NO: 443 - RNA, 16 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
guucuguccaagcccg

SEQ ID NO: 444 - RNA, 15 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
guucuguccaagccc

SEQ ID NO: 445 - RNA, 14 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(14): 5-methyl
guucuguccaagcc

SEQ ID NO: 446 - RNA, 13 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(13): 5-methyl
guucuguccaagc

SEQ ID NO: 447 - RNA, 12 nt, Artificial Sequence
  Description of Artificial Sequence: Synthetic Antisense oligonucleotide
  misc_feature (4)..(4): 5-methyl
  misc_feature (8)..(9): 5-methyl
guucuguccaag

SEQ ID NO: 448 - RNA, 11 nt, Artificial Sequence
  Description of Artificial Sequence: Synthetic Antisense oligonucleotide
  misc_feature (4)..(4): 5-methyl
  misc_feature (8)..(9): 5-methyl
guucuguccaa

SEQ ID NO: 449 - RNA, 10 nt, Artificial Sequence
  Description of Artificial Sequence: Synthetic Antisense oligonucleotide
  misc_feature (4)..(4): 5-methyl
  misc_feature (8)..(9): 5-methyl
guucugucca

SEQ ID NO: 450 - RNA, 9 nt, Artificial Sequence
  Description of Artificial Sequence: Synthetic Antisense oligonucleotide
  misc_feature (4)..(4): 5-methyl
  misc_feature (8)..(9): 5-methyl
guucugucc

SEQ ID NO: 451 - RNA, 8 nt, Artificial Sequence
  Description of Artificial Sequence: Synthetic Antisense oligonucleotide
  misc_feature (4)..(4): 5-methyl
  misc_feature (8)..(8): 5-methyl
guucuguc

SEQ ID NO: 452 - RNA, 20 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
aguucuguccaagcccgguu

SEQ ID NO: 453 - RNA, 19 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
aguucuguccaagcccggu

SEQ ID NO: 454 - RNA, 18 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
aguucuguccaagcccgg

SEQ ID NO: 455 - RNA, 17 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
aguucuguccaagcccg

SEQ ID NO: 456 - RNA, 16 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
aguucuguccaagccc

SEQ ID NO: 457 - RNA, 15 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(15): 5-methyl
aguucuguccaagcc

SEQ ID NO: 458 - RNA, 14 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(14): 5-methyl
aguucuguccaagc

SEQ ID NO: 459 - RNA, 13 nt, Artificial Sequence
  Description of Artificial Sequence: Synthetic Antisense oligonucleotide
  misc_feature (5)..(5): 5-methyl
  misc_feature (9)..(10): 5-methyl
aguucuguccaag

SEQ ID NO: 460 - RNA, 12 nt, Artificial Sequence
  Description of Artificial Sequence: Synthetic Antisense oligonucleotide
  misc_feature (5)..(5): 5-methyl
  misc_feature (9)..(10): 5-methyl
aguucuguccaa

SEQ ID NO: 461 - RNA, 11 nt, Artificial Sequence
  Description of Artificial Sequence: Synthetic Antisense oligonucleotide
  misc_feature (5)..(5): 5-methyl
  misc_feature (9)..(10): 5-methyl
aguucugucca

SEQ ID NO: 462 - RNA, 10 nt, Artificial Sequence
  Description of Artificial Sequence: Synthetic Antisense oligonucleotide
  misc_feature (5)..(5): 5-methyl
  misc_feature (9)..(10): 5-methyl
aguucugucc

SEQ ID NO: 463 - RNA, 9 nt, Artificial Sequence
  Description of Artificial Sequence: Synthetic Antisense oligonucleotide
  misc_feature (5)..(5): 5-methyl
  misc_feature (9)..(9): 5-methyl
aguucuguc

SEQ ID NO: 464 - RNA, 8 nt, Artificial Sequence
  Description of Artificial Sequence: Synthetic Antisense oligonucleotide
  misc_feature (5)..(5): 5-methyl
aguucugu

SEQ ID NO: 465 - RNA, 20 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
aaguucuguccaagcccggu

SEQ ID NO: 466 - RNA, 19 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
aaguucuguccaagcccgg

SEQ ID NO: 467 - RNA, 18 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
aaguucuguccaagcccg

SEQ ID NO: 468 - RNA, 17 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
aaguucuguccaagccc

SEQ ID NO: 469 - RNA, 16 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(16): 5-methyl
aaguucuguccaagcc

SEQ ID NO: 470 - RNA, 15 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(15): 5-methyl
aaguucuguccaagc

SEQ ID NO: 471 - RNA, 14 nt, Artificial Sequence
  Description of Artificial Sequence: Synthetic Antisense oligonucleotide
  misc_feature (6)..(6): 5-methyl
  misc_feature (10)..(11): 5-methyl
aaguucuguccaag

SEQ ID NO: 472 - RNA, 13 nt, Artificial Sequence
  Description of Artificial Sequence: Synthetic Antisense oligonucleotide
  misc_feature (6)..(6): 5-methyl
  misc_feature (10)..(11): 5-methyl
aaguucuguccaa

SEQ ID NO: 473 - RNA, 12 nt, Artificial Sequence
  Description of Artificial Sequence: Synthetic Antisense oligonucleotide
  misc_feature (6)..(6): 5-methyl
  misc_feature (10)..(11): 5-methyl
aaguucugucca

SEQ ID NO: 474 - RNA, 11 nt, Artificial Sequence
  Description of Artificial Sequence: Synthetic Antisense oligonucleotide
  misc_feature (6)..(6): 5-methyl
  misc_feature (10)..(11): 5-methyl
aaguucugucc

SEQ ID NO: 475 - RNA, 10 nt, Artificial Sequence
  Description of Artificial Sequence: Synthetic Antisense oligonucleotide
  misc_feature (6)..(6): 5-methyl
  misc_feature (10)..(10): 5-methyl
aaguucuguc

SEQ ID NO: 476 - RNA, 9 nt, Artificial Sequence
  Description of Artificial Sequence: Synthetic Antisense oligonucleotide
  misc_feature (6)..(6): 5-methyl
aaguucugu

SEQ ID NO: 477 - RNA, 8 nt, Artificial Sequence
  Description of Artificial Sequence: Synthetic Antisense oligonucleotide
  misc_feature (6)..(6): 5-methyl
aaguucug

SEQ ID NO: 478 - RNA, 20 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
uaaguucuguccaagcccgg

SEQ ID NO: 479 - RNA, 19 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
uaaguucuguccaagcccg

SEQ ID NO: 480 - RNA, 18 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
uaaguucuguccaagccc

SEQ ID NO: 481 - RNA, 17 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(17): 5-methyl
uaaguucuguccaagcc

SEQ ID NO: 482 - RNA, 16 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(16): 5-methyl
uaaguucuguccaagc

SEQ ID NO: 483 - RNA, 14 nt, Artificial Sequence
  Description of Artificial Sequence: Synthetic Antisense oligonucleotide
  misc_feature (7)..(7): 5-methyl
  misc_feature (11)..(12): 5-methyl
uaaguucuguccaa

SEQ ID NO: 484 - RNA, 13 nt, Artificial Sequence
  Description of Artificial Sequence: Synthetic Antisense oligonucleotide
  misc_feature (7)..(7): 5-methyl
  misc_feature (11)..(12): 5-methyl
uaaguucugucca

SEQ ID NO: 485 - RNA, 12 nt, Artificial Sequence
  Description of Artificial Sequence: Synthetic Antisense oligonucleotide
  misc_feature (7)..(7): 5-methyl
  misc_feature (11)..(12): 5-methyl
uaaguucugucc

SEQ ID NO: 486 - RNA, 11 nt, Artificial Sequence
  Description of Artificial Sequence: Synthetic Antisense oligonucleotide
  misc_feature (7)..(7): 5-methyl
  misc_feature (11)..(11): 5-methyl
uaaguucuguc

SEQ ID NO: 487 - RNA, 10 nt, Artificial Sequence
  Description of Artificial Sequence: Synthetic Antisense oligonucleotide
  misc_feature (7)..(7): 5-methyl
uaaguucugu

SEQ ID NO: 488 - RNA, 9 nt, Artificial Sequence
  Description of Artificial Sequence: Synthetic Antisense oligonucleotide
  misc_feature (7)..(7): 5-methyl
uaaguucug

SEQ ID NO: 489 - RNA, 8 nt, Artificial Sequence
  Description of Artificial Sequence: Synthetic Antisense oligonucleotide
  misc_feature (7)..(7): 5-methyl
uaaguucu

SEQ ID NO: 490 - RNA, 20 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(19): 5-methyl
guaaguucuguccaagcccg

SEQ ID NO: 491 - RNA, 19 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(19): 5-methyl
guaaguucuguccaagccc

SEQ ID NO: 492 - RNA, 17 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(17): 5-methyl
guaaguucuguccaagc

SEQ ID NO: 493 - RNA, 16 nt, Artificial Sequence
  Description of Artificial Sequence: Synthetic Antisense oligonucleotide
  misc_feature (8)..(8): 5-methyl
  misc_feature (12)..(13): 5-methyl
guaaguucuguccaag

SEQ ID NO: 494 - RNA, 15 nt, Artificial Sequence
  Description of Artificial Sequence: Synthetic Antisense oligonucleotide
  misc_feature (8)..(8): 5-methyl
  misc_feature (12)..(13): 5-methyl
guaaguucuguccaa

SEQ ID NO: 495 - RNA, 14 nt, Artificial Sequence
  Description of Artificial Sequence: Synthetic Antisense oligonucleotide
  misc_feature (8)..(8): 5-methyl
  misc_feature (12)..(13): 5-methyl
guaaguucugucca

SEQ ID NO: 496 - RNA, 13 nt, Artificial Sequence
  Description of Artificial Sequence: Synthetic Antisense oligonucleotide
  misc_feature (8)..(8): 5-methyl
  misc_feature (12)..(13): 5-methyl
guaaguucugucc

SEQ ID NO: 497 - RNA, 12 nt, Artificial Sequence
  Description of Artificial Sequence: Synthetic Antisense oligonucleotide
  misc_feature (8)..(8): 5-methyl
  misc_feature (12)..(12): 5-methyl
guaaguucuguc

SEQ ID NO: 498 - RNA, 11 nt, Artificial Sequence
  Description of Artificial Sequence: Synthetic Antisense oligonucleotide
  misc_feature (8)..(8): 5-methyl
guaaguucugu

SEQ ID NO: 499 - RNA, 10 nt, Artificial Sequence
  Description of Artificial Sequence: Synthetic Antisense oligonucleotide
  misc_feature (8)..(8): 5-methyl
guaaguucug

SEQ ID NO: 500 - RNA, 9 nt, Artificial Sequence
  Description of Artificial Sequence: Synthetic Antisense oligonucleotide
  misc_feature (8)..(8): 5-methyl
guaaguucu

SEQ ID NO: 501 - RNA, 8 nt, Artificial Sequence
  Description of Artificial Sequence: Synthetic Antisense oligonucleotide
  misc_feature (8)..(8): 5-methyl
guaaguuc

SEQ ID NO: 502 - RNA, 20 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(20): 5-methyl
gguaaguucuguccaagccc

SEQ ID NO: 503 - RNA, 19 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(19): 5-methyl
gguaaguucuguccaagcc

SEQ ID NO: 504 - RNA, 17 nt, Artificial Sequence
  Description of Artificial Sequence: Synthetic Antisense oligonucleotide
  misc_feature (9)..(9): 5-methyl
  misc_feature (13)..(14): 5-methyl
gguaaguucuguccaag

SEQ ID NO: 505 - RNA, 16 nt, Artificial Sequence
  Description of Artificial Sequence: Synthetic Antisense oligonucleotide
  misc_feature (9)..(9): 5-methyl
  misc_feature (13)..(14): 5-methyl
gguaaguucuguccaa

SEQ ID NO: 506 - RNA, 15 nt, Artificial Sequence
  Description of Artificial Sequence: Synthetic Antisense oligonucleotide
  misc_feature (9)..(9): 5-methyl
  misc_feature (13)..(14): 5-methyl
gguaaguucugucca

SEQ ID NO: 507 - RNA, 14 nt, Artificial Sequence
  Description of Artificial Sequence: Synthetic Antisense oligonucleotide
  misc_feature (9)..(9): 5-methyl
  misc_feature (13)..(14): 5-methyl
gguaaguucugucc

SEQ ID NO: 508 - RNA, 13 nt, Artificial Sequence
  Description of Artificial Sequence: Synthetic Antisense oligonucleotide
  misc_feature (9)..(9): 5-methyl
  misc_feature (13)..(13): 5-methyl
gguaaguucuguc

SEQ ID NO: 509 - RNA, 12 nt, Artificial Sequence
  Description of Artificial Sequence: Synthetic Antisense oligonucleotide
  misc_feature (9)..(9): 5-methyl
gguaaguucugu

SEQ ID NO: 510 - RNA, 11 nt, Artificial Sequence
  Description of Artificial Sequence: Synthetic Antisense oligonucleotide
  misc_feature (9)..(9): 5-methyl
gguaaguucug

SEQ ID NO: 511 - RNA, 10 nt, Artificial Sequence
  Description of Artificial Sequence: Synthetic Antisense oligonucleotide
  misc_feature (9)..(9): 5-methyl
gguaaguucu

SEQ ID NO: 512 - RNA, 9 nt, Artificial Sequence
  Description of Artificial Sequence: Synthetic Antisense oligonucleotide
  misc_feature (9)..(9): 5-methyl
gguaaguuc

SEQ ID NO: 513 - RNA, 20 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(20): 5-methyl
cgguaaguucuguccaagcc

SEQ ID NO: 514 - RNA, 19 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(19): 5-methyl
cgguaaguucuguccaagc

SEQ ID NO: 515 - RNA, 18 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
cgguaaguucuguccaag

SEQ ID NO: 516 - RNA, 17 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
cgguaaguucuguccaa

SEQ ID NO: 517 - RNA, 16 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
cgguaaguucugucca

SEQ ID NO: 518 - RNA, 15 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
cgguaaguucugucc

SEQ ID NO: 519 - RNA, 14 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(14): 5-methyl
cgguaaguucuguc

SEQ ID NO: 520 - RNA, 13 nt, Artificial Sequence
  Description of Artificial Sequence: Synthetic Antisense oligonucleotide
  misc_feature (1)..(1): 5-methyl
  misc_feature (10)..(10): 5-methyl
cgguaaguucugu

SEQ ID NO: 521 - RNA, 12 nt, Artificial Sequence
  Description of Artificial Sequence: Synthetic Antisense oligonucleotide
  misc_feature (1)..(1): 5-methyl
  misc_feature (10)..(10): 5-methyl
cgguaaguucug

SEQ ID NO: 522 - RNA, 11 nt, Artificial Sequence
  Description of Artificial Sequence: Synthetic Antisense oligonucleotide
  misc_feature (1)..(1): 5-methyl
  misc_feature (10)..(10): 5-methyl
cgguaaguucu

SEQ ID NO: 523 - RNA, 10 nt, Artificial Sequence
  Description of Artificial Sequence: Synthetic Antisense oligonucleotide
  misc_feature (1)..(1): 5-methyl
  misc_feature (10)..(10): 5-methyl
cgguaaguuc

SEQ ID NO: 524 - RNA, 9 nt, Artificial Sequence
  Description of Artificial Sequence: Synthetic Antisense oligonucleotide
  misc_feature (1)..(1): 5-methyl
cgguaaguu

SEQ ID NO: 525 - RNA, 8 nt, Artificial Sequence
  Description of Artificial Sequence: Synthetic Antisense oligonucleotide
  misc_feature (1)..(1): 5-methyl
cgguaagu

SEQ ID NO: 526 - RNA, 20 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (20)..(20): 5-methyl
ucgguaaguucuguccaagc

SEQ ID NO: 527 - RNA, 19 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
ucgguaaguucuguccaag

SEQ ID NO: 528 - RNA, 18 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
ucgguaaguucuguccaa

SEQ ID NO: 529 - RNA, 17 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
ucgguaaguucugucca

SEQ ID NO: 530 - RNA, 16 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
ucgguaaguucugucc

SEQ ID NO: 531 - RNA, 15 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(15): 5-methyl
ucgguaaguucuguc

SEQ ID NO: 532 - RNA, 14 nt, Artificial Sequence
  Description of Artificial Sequence: Synthetic Antisense oligonucleotide
  misc_feature (2)..(2): 5-methyl
  misc_feature (11)..(11): 5-methyl
ucgguaaguucugu

SEQ ID NO: 533 - RNA, 13 nt, Artificial Sequence
  Description of Artificial Sequence: Synthetic Antisense oligonucleotide
  misc_feature (2)..(2): 5-methyl
  misc_feature (11)..(11): 5-methyl
ucgguaaguucug

SEQ ID NO: 534 - RNA, 12 nt, Artificial Sequence
  Description of Artificial Sequence: Synthetic Antisense oligonucleotide
  misc_feature (2)..(2): 5-methyl
  misc_feature (11)..(11): 5-methyl
ucgguaaguucu

SEQ ID NO: 535 - RNA, 11 nt, Artificial Sequence
  Description of Artificial Sequence: Synthetic Antisense oligonucleotide
  misc_feature (2)..(2): 5-methyl
  misc_feature (11)..(11): 5-methyl
ucgguaaguuc

SEQ ID NO: 536 - RNA, 10 nt, Artificial Sequence
  Description of Artificial Sequence: Synthetic Antisense oligonucleotide
  misc_feature (2)..(2): 5-methyl
ucgguaaguu

SEQ ID NO: 537 - RNA, 9 nt, Artificial Sequence
  Description of Artificial Sequence: Synthetic Antisense oligonucleotide
  misc_feature (2)..(2): 5-methyl
ucgguaagu

SEQ ID NO: 538 - RNA, 20 nt, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
gucgguaaguucuguccaag

SEQ ID NO: 539 - RNA, 19 nt, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
gucgguaaguucuguccaa

SEQ ID NO: 540 - RNA, 18 nt, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
gucgguaaguucugucca

SEQ ID NO: 541 - RNA, 17 nt, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
gucgguaaguucugucc

SEQ ID NO: 542 - RNA, 16 nt, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(16): 5-methyl
gucgguaaguucuguc

SEQ ID NO: 543 - RNA, 15 nt, Artificial Sequence
  Description of Artificial Sequence: Synthetic Antisense oligonucleotide
  misc_feature (3)..(3): 5-methyl
  misc_feature (12)..(12): 5-methyl
gucgguaaguucugu

SEQ ID NO: 544 - RNA, 14 nt, Artificial Sequence
  Description of Artificial Sequence: Synthetic Antisense oligonucleotide
  misc_feature (3)..(3): 5-methyl
  misc_feature (12)..(12): 5-methyl
gucgguaaguucug

SEQ ID NO: 545 - RNA, 13 nt, Artificial Sequence
  Description of Artificial Sequence: Synthetic Antisense oligonucleotide
  misc_feature (3)..(3): 5-methyl
  misc_feature (12)..(12): 5-methyl
gucgguaaguucu

SEQ ID NO: 546 - RNA, 12 nt, Artificial Sequence
  Description of Artificial Sequence: Synthetic Antisense oligonucleotide
  misc_feature (3)..(3): 5-methyl
  misc_feature (12)..(12): 5-methyl
gucgguaaguuc

SEQ ID NO: 547 - RNA, 11 nt, Artificial Sequence
  Description of Artificial Sequence: Synthetic Antisense oligonucleotide
  misc_feature (3)..(3): 5-methyl
gucgguaaguu

SEQ ID NO: 548 - RNA, 10 nt, Artificial Sequence
  Description of Artificial Sequence: Synthetic Antisense oligonucleotide
  misc_feature (3)..(3): 5-methyl
gucgguaagu

SEQ ID NO: 549 - RNA, 20 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agucgguaaguucuguccaa

SEQ ID NO: 550 - RNA, 19 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agucgguaaguucugucca

SEQ ID NO: 551 - RNA, 17 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(17): 5-methyl
agucgguaaguucuguc

SEQ ID NO: 552 - RNA, 16 nt, Artificial Sequence
  Description of Artificial Sequence: Synthetic Antisense oligonucleotide
  misc_feature (4)..(4): 5-methyl
  misc_feature (13)..(13): 5-methyl
agucgguaaguucugu

SEQ ID NO: 553 - RNA, 15 nt, Artificial Sequence
  Description of Artificial Sequence: Synthetic Antisense oligonucleotide
  misc_feature (4)..(4): 5-methyl
  misc_feature (13)..(13): 5-methyl
agucgguaaguucug

SEQ ID NO: 554 - RNA, 14 nt, Artificial Sequence
  Description of Artificial Sequence: Synthetic Antisense oligonucleotide
  misc_feature (4)..(4): 5-methyl
  misc_feature (13)..(13): 5-methyl
agucgguaaguucu

SEQ ID NO: 555 - RNA, 13 nt, Artificial Sequence
  Description of Artificial Sequence: Synthetic Antisense oligonucleotide
  misc_feature (4)..(4): 5-methyl
  misc_feature (13)..(13): 5-methyl
agucgguaaguuc

SEQ ID NO: 556 - RNA, 12 nt, Artificial Sequence
  Description of Artificial Sequence: Synthetic Antisense oligonucleotide
  misc_feature (4)..(4): 5-methyl
agucgguaaguu

SEQ ID NO: 557 - RNA, 11 nt, Artificial Sequence
  Description of Artificial Sequence: Synthetic Antisense oligonucleotide
  misc_feature (4)..(4): 5-methyl
agucgguaagu

SEQ ID NO: 558 - RNA, 20 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
cagucgguaaguucugucca

SEQ ID NO: 559 - RNA, 19 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
cagucgguaaguucugucc

SEQ ID NO: 560 - RNA, 18 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(18): 5-methyl
cagucgguaaguucuguc

SEQ ID NO: 561 - RNA, 17 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
cagucgguaaguucugu

SEQ ID NO: 562 - RNA, 16 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
cagucgguaaguucug

SEQ ID NO: 563 - RNA, 15 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
cagucgguaaguucu

SEQ ID NO: 564 - RNA, 14 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
cagucgguaaguuc

SEQ ID NO: 565 - RNA, 13 nt, Artificial Sequence
  Description of Artificial Sequence: Synthetic Antisense oligonucleotide
  misc_feature (1)..(1): 5-methyl
  misc_feature (5)..(5): 5-methyl
cagucgguaaguu

SEQ ID NO: 566 - RNA, 12 nt, Artificial Sequence
  Description of Artificial Sequence: Synthetic Antisense oligonucleotide
  misc_feature (1)..(1): 5-methyl
  misc_feature (5)..(5): 5-methyl
cagucgguaagu

SEQ ID NO: 567 - RNA, 20 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(20): 5-methyl
ccagucgguaaguucugucc

SEQ ID NO: 568 - RNA, 19 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(19): 5-methyl
ccagucgguaaguucuguc

SEQ ID NO: 569 - RNA, 18 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
ccagucgguaaguucugu

SEQ ID NO: 570 - RNA, 17 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
ccagucgguaaguucug

SEQ ID NO: 571 - RNA, 16 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
ccagucgguaaguucu

SEQ ID NO: 572 - RNA, 15 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
ccagucgguaaguuc

SEQ ID NO: 573 - RNA, 14 nt, Artificial Sequence
  Description of Artificial Sequence: Synthetic Antisense oligonucleotide
  misc_feature (1)..(2): 5-methyl
  misc_feature (6)..(6): 5-methyl
ccagucgguaaguu

SEQ ID NO: 574 - RNA, 13 nt, Artificial Sequence
  Description of Artificial Sequence: Synthetic Antisense oligonucleotide
  misc_feature (1)..(2): 5-methyl
  misc_feature (6)..(6): 5-methyl
ccagucgguaagu

SEQ ID NO: 575 - RNA, 20 nt, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
  misc_feature (20)..(20): 5-methyl
gccagucgguaaguucuguc

SEQ ID NO: 576 - RNA, 19 nt, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
gccagucgguaaguucugu

SEQ ID NO: 577 - RNA, 18 nt, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
gccagucgguaaguucug

SEQ ID NO: 578 - RNA, 17 nt, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
gccagucgguaaguucu

SEQ ID NO: 579 - RNA, 16 nt, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
gccagucgguaaguuc

SEQ ID NO: 580 - RNA, 15 nt, Artificial Sequence
  Description of Artificial Sequence: Synthetic Antisense oligonucleotide
  misc_feature (2)..(3): 5-methyl
  misc_feature (7)..(7): 5-methyl
gccagucgguaaguu

SEQ ID NO: 581 - RNA, 14 nt, Artificial Sequence
  Description of Artificial Sequence: Synthetic Antisense oligonucleotide
  misc_feature (2)..(3): 5-methyl
  misc_feature (7)..(7): 5-methyl
gccagucgguaagu

SEQ ID NO: 582 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucu

SEQ ID NO: 583 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucuag

SEQ ID NO: 584 - RNA, 16 nt, Artificial Sequence
  Description of Artificial Sequence: Synthetic Antisense oligonucleotide
  misc_feature (2)..(2): 5-methyl
  misc_feature (14)..(14): 5-methyl
ucaaggaagauggcau

SEQ ID NO: 585 - RNA, 15 nt, Artificial Sequence
  Description of Artificial Sequence: Synthetic Antisense oligonucleotide
  misc_feature (9)..(9): 5-methyl
  misc_feature (14)..(14): 5-methyl
gaagauggcauuucu

SEQ ID NO: 586 - RNA, 21 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucua

SEQ ID NO: 587 - RNA, 19 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuuc

SEQ ID NO: 588 - RNA, 18 nt, Artificial Sequence
  Description of Artificial Sequence: Synthetic Antisense oligonucleotide
  misc_feature (2)..(2): 5-methyl
  misc_feature (14)..(14): 5-methyl
ucaaggaagauggcauuu

SEQ ID NO: 589 - RNA, 17 nt, Artificial Sequence
  Description of Artificial Sequence: Synthetic Antisense oligonucleotide
  misc_feature (2)..(2): 5-methyl
  misc_feature (14)..(14): 5-methyl
ucaaggaagauggcauu

SEQ ID NO: 590 - RNA, 15 nt, Artificial Sequence
  Description of Artificial Sequence: Synthetic Antisense oligonucleotide
  misc_feature (2)..(2): 5-methyl
  misc_feature (14)..(14): 5-methyl
ucaaggaagauggca

SEQ ID NO: 591 - RNA, 14 nt, Artificial Sequence
  Description of Artificial Sequence: Synthetic Antisense oligonucleotide
  misc_feature (2)..(2): 5-methyl
  misc_feature (14)..(14): 5-methyl
ucaaggaagauggc

SEQ ID NO: 592 - RNA, 13 nt, Artificial Sequence
  Description of Artificial Sequence: Synthetic Antisense oligonucleotide
  misc_feature (2)..(2): 5-methyl
ucaaggaagaugg

SEQ ID NO: 593 - RNA, 12 nt, Artificial Sequence
  Description of Artificial Sequence: Synthetic Antisense oligonucleotide
  misc_feature (2)..(2): 5-methyl
ucaaggaagaug

SEQ ID NO: 594 - RNA, 11 nt, Artificial Sequence
  Description of Artificial Sequence: Synthetic Antisense oligonucleotide
  misc_feature (2)..(2): 5-methyl
ucaaggaagau

SEQ ID NO: 595 - RNA, 10 nt, Artificial Sequence
  Description of Artificial Sequence: Synthetic Antisense oligonucleotide
  misc_feature (2)..(2): 5-methyl
ucaaggaaga

SEQ ID NO: 596 - RNA, 9 nt, Artificial Sequence
  Description of Artificial Sequence: Synthetic Antisense oligonucleotide
  misc_feature (2)..(2): 5-methyl
ucaaggaag

SEQ ID NO: 597 - RNA, 21 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
caaggaagauggcauuucuag

SEQ ID NO: 598 - RNA, 20 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
caaggaagauggcauuucua

SEQ ID NO: 599 - RNA, 19 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
caaggaagauggcauuucu

SEQ ID NO: 600 - RNA, 18 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
caaggaagauggcauuuc

SEQ ID NO: 601 - RNA, 17 nt, Artificial Sequence
  Description of Artificial Sequence: Synthetic Antisense oligonucleotide
  misc_feature (1)..(1): 5-methyl
  misc_feature (13)..(13): 5-methyl
caaggaagauggcauuu

SEQ ID NO: 602 - RNA, 16 nt, Artificial Sequence
  Description of Artificial Sequence: Synthetic Antisense oligonucleotide
  misc_feature (1)..(1): 5-methyl
  misc_feature (13)..(13): 5-methyl
caaggaagauggcauu

SEQ ID NO: 603 - RNA, 15 nt, Artificial Sequence
  Description of Artificial Sequence: Synthetic Antisense oligonucleotide
  misc_feature (1)..(1): 5-methyl
  misc_feature (13)..(13): 5-methyl
caaggaagauggcau

SEQ ID NO: 604 - RNA, 14 nt, Artificial Sequence
  Description of Artificial Sequence: Synthetic Antisense oligonucleotide
  misc_feature (1)..(1): 5-methyl
  misc_feature (13)..(13): 5-methyl
caaggaagauggca

SEQ ID NO: 605 - RNA, 13 nt, Artificial Sequence
  Description of Artificial Sequence: Synthetic Antisense oligonucleotide
  misc_feature (1)..(1): 5-methyl
  misc_feature (13)..(13): 5-methyl
caaggaagauggc

SEQ ID NO: 606 - RNA, 12 nt, Artificial Sequence
  Description of Artificial Sequence: Synthetic Antisense oligonucleotide
  misc_feature (1)..(1): 5-methyl
caaggaagaugg

SEQ ID NO: 607 - RNA, 11 nt, Artificial Sequence
  Description of Artificial Sequence: Synthetic Antisense oligonucleotide
  misc_feature (1)..(1): 5-methyl
caaggaagaug

SEQ ID NO: 608 - RNA, 10 nt, Artificial Sequence
  Description of Artificial Sequence: Synthetic Antisense oligonucleotide
  misc_feature (1)..(1): 5-methyl
caaggaagau

SEQ ID NO: 609 - RNA, 9 nt, Artificial Sequence
  Description of Artificial Sequence: Synthetic Antisense oligonucleotide
  misc_feature (1)..(1): 5-methyl
caaggaaga

SEQ ID NO: 610 - RNA, 8 nt, Artificial Sequence
  Description of Artificial Sequence: Synthetic Antisense oligonucleotide
  misc_feature (1)..(1): 5-methyl
caaggaag

SEQ ID NO: 611 - RNA, 20 nt, Artificial Sequence
  Description of Artificial Sequence: Synthetic Antisense oligonucleotide
  misc_feature (12)..(12): 5-methyl
  misc_feature (17)..(17): 5-methyl
aaggaagauggcauuucuag

SEQ ID NO: 612 - RNA, 19 nt, Artificial Sequence
  Description of Artificial Sequence: Synthetic Antisense oligonucleotide
  misc_feature (12)..(12): 5-methyl
  misc_feature (17)..(17): 5-methyl
aaggaagauggcauuucua

SEQ ID NO: 613 - RNA, 18 nt, Artificial Sequence
  Description of Artificial Sequence: Synthetic Antisense oligonucleotide
  misc_feature (12)..(12): 5-methyl
  misc_feature (17)..(17): 5-methyl
aaggaagauggcauuucu

SEQ ID NO: 614 - RNA, 17 nt, Artificial Sequence
  Description of Artificial Sequence: Synthetic Antisense oligonucleotide
  misc_feature (12)..(12): 5-methyl
  misc_feature (17)..(17): 5-methyl
aaggaagauggcauuuc

SEQ ID NO: 615 - RNA, 16 nt, Artificial Sequence
  Description of Artificial Sequence: Synthetic Antisense oligonucleotide
  misc_feature (12)..(12): 5-methyl
aaggaagauggcauuu

SEQ ID NO: 616 - RNA, 15 nt, Artificial Sequence
  Description of Artificial Sequence: Synthetic Antisense oligonucleotide
  misc_feature (12)..(12): 5-methyl
aaggaagauggcauu

SEQ ID NO: 617 - RNA, 14 nt, Artificial Sequence
  Description of Artificial Sequence: Synthetic Antisense oligonucleotide
  misc_feature (12)..(12): 5-methyl
aaggaagauggcau

SEQ ID NO: 618 - RNA, 13 nt, Artificial Sequence
  Description of Artificial Sequence: Synthetic Antisense oligonucleotide
  misc_feature (12)..(12): 5-methyl
aaggaagauggca

SEQ ID NO: 619 - RNA, 12 nt, Artificial Sequence
  Description of Artificial Sequence: Synthetic Antisense oligonucleotide
  misc_feature (12)..(12): 5-methyl
aaggaagauggc

SEQ ID NO: 620 - RNA, 19 nt, Artificial Sequence
  Description of Artificial Sequence: Synthetic Antisense oligonucleotide
  misc_feature (11)..(11): 5-methyl
  misc_feature (16)..(16): 5-methyl
aggaagauggcauuucuag

SEQ ID NO: 621 - RNA, 18 nt, Artificial Sequence
  Description of Artificial Sequence: Synthetic Antisense oligonucleotide
  misc_feature (11)..(11): 5-methyl
  misc_feature (16)..(16): 5-methyl
aggaagauggcauuucua

SEQ ID NO: 622 - RNA, 17 nt, Artificial Sequence
  Description of Artificial Sequence: Synthetic Antisense oligonucleotide
  misc_feature (11)..(11): 5-methyl
  misc_feature (16)..(16): 5-methyl
aggaagauggcauuucu

SEQ ID NO: 623 - RNA, 16 nt, Artificial Sequence
  Description of Artificial Sequence: Synthetic Antisense oligonucleotide
  misc_feature (11)..(11): 5-methyl
  misc_feature (16)..(16): 5-methyl
aggaagauggcauuuc

SEQ ID NO: 624 - RNA, 15 nt, Artificial Sequence
  Description of Artificial Sequence: Synthetic Antisense oligonucleotide
  misc_feature (11)..(11): 5-methyl
aggaagauggcauuu

SEQ ID NO: 625 - RNA, 14 nt, Artificial Sequence
  Description of Artificial Sequence: Synthetic Antisense oligonucleotide
  misc_feature (11)..(11): 5-methyl
aggaagauggcauu

SEQ ID NO: 626 - RNA, 13 nt, Artificial Sequence
  Description of Artificial Sequence: Synthetic Antisense oligonucleotide
  misc_feature (11)..(11): 5-methyl
aggaagauggcau

SEQ ID NO: 627 - RNA, 12 nt, Artificial Sequence
  Description of Artificial Sequence: Synthetic Antisense oligonucleotide
  misc_feature (11)..(11): 5-methyl
aggaagauggca

SEQ ID NO: 628 - RNA, 18 nt, Artificial Sequence
  Description of Artificial Sequence: Synthetic Antisense oligonucleotide
  misc_feature (10)..(10): 5-methyl
  misc_feature (15)..(15): 5-methyl
ggaagauggcauuucuag

SEQ ID NO: 629 - RNA, 17 nt, Artificial Sequence
  Description of Artificial Sequence: Synthetic Antisense oligonucleotide
  misc_feature (10)..(10): 5-methyl
  misc_feature (15)..(15): 5-methyl
ggaagauggcauuucua

SEQ ID NO: 630 - RNA, 16 nt, Artificial Sequence
  Description of Artificial Sequence: Synthetic Antisense oligonucleotide
  misc_feature (10)..(10): 5-methyl
  misc_feature (15)..(15): 5-methyl
ggaagauggcauuucu

SEQ ID NO: 631 - RNA, 15 nt, Artificial Sequence
  Description of Artificial Sequence: Synthetic Antisense oligonucleotide
  misc_feature (10)..(10): 5-methyl
  misc_feature (15)..(15): 5-methyl
ggaagauggcauuuc

SEQ ID NO: 632 - RNA, 14 nt, Artificial Sequence
  Description of Artificial Sequence: Synthetic Antisense oligonucleotide
  misc_feature (10)..(10): 5-methyl
ggaagauggcauuu

SEQ ID NO: 633 - RNA, 13 nt, Artificial Sequence
  Description of Artificial Sequence: Synthetic Antisense oligonucleotide
  misc_feature (10)..(10): 5-methyl
ggaagauggcauu

SEQ ID NO: 634 - RNA, 12 nt, Artificial Sequence
  Description of Artificial Sequence: Synthetic Antisense oligonucleotide
  misc_feature (10)..(10): 5-methyl
ggaagauggcau

SEQ ID NO: 635 - RNA, 11 nt, Artificial Sequence
  Description of Artificial Sequence: Synthetic Antisense oligonucleotide
  misc_feature (10)..(10): 5-methyl
ggaagauggca

SEQ ID NO: 636 - RNA, 10 nt, Artificial Sequence
  Description of Artificial Sequence: Synthetic Antisense oligonucleotide
  misc_feature (10)..(10): 5-methyl
ggaagauggc

SEQ ID NO: 637 - RNA, 17 nt, Artificial Sequence
  Description of Artificial Sequence: Synthetic Antisense oligonucleotide
  misc_feature (9)..(9): 5-methyl
  misc_feature (14)..(14): 5-methyl
gaagauggcauuucuag

SEQ ID NO: 638 - RNA, 16 nt, Artificial Sequence
  Description of Artificial Sequence: Synthetic Antisense oligonucleotide
  misc_feature (9)..(9): 5-methyl
  misc_feature (14)..(14): 5-methyl
gaagauggcauuucua

SEQ ID NO: 639 - RNA, 14 nt, Artificial Sequence
  Description of Artificial Sequence: Synthetic Antisense oligonucleotide
  misc_feature (9)..(9): 5-methyl
  misc_feature (14)..(14): 5-methyl
gaagauggcauuuc

SEQ ID NO: 640 - RNA, 13 nt, Artificial Sequence
  Description of Artificial Sequence: Synthetic Antisense oligonucleotide
  misc_feature (9)..(9): 5-methyl
gaagauggcauuu

SEQ ID NO: 641 - RNA, 12 nt, Artificial Sequence
  Description of Artificial Sequence: Synthetic Antisense oligonucleotide
  misc_feature (9)..(9): 5-methyl
gaagauggcauu

SEQ ID NO: 642 - RNA, 11 nt, Artificial Sequence
  Description of Artificial Sequence: Synthetic Antisense oligonucleotide
  misc_feature (9)..(9): 5-methyl
gaagauggcau

SEQ ID NO: 643 - RNA, 10 nt, Artificial Sequence
  Description of Artificial Sequence: Synthetic Antisense oligonucleotide
  misc_feature (9)..(9): 5-methyl
gaagauggca

SEQ ID NO: 644 - RNA, 9 nt, Artificial Sequence
  Description of Artificial Sequence: Synthetic Antisense oligonucleotide
  misc_feature (9)..(9): 5-methyl
gaagauggc

SEQ ID NO: 645 - RNA, 16 nt, Artificial Sequence
  Description of Artificial Sequence: Synthetic Antisense oligonucleotide
  misc_feature (8)..(8): 5-methyl
  misc_feature (13)..(13): 5-methyl
aagauggcauuucuag

SEQ ID NO: 646 - RNA, 15 nt, Artificial Sequence
  Description of Artificial Sequence: Synthetic Antisense oligonucleotide
  misc_feature (8)..(8): 5-methyl
  misc_feature (13)..(13): 5-methyl
aagauggcauuucua

SEQ ID NO: 647 - RNA, 14 nt, Artificial Sequence
  Description of Artificial Sequence: Synthetic Antisense oligonucleotide
  misc_feature (8)..(8): 5-methyl
  misc_feature (13)..(13): 5-methyl
aagauggcauuucu

SEQ ID NO: 648 - RNA, 13 nt, Artificial Sequence
  Description of Artificial Sequence: Synthetic Antisense oligonucleotide
  misc_feature (8)..(8): 5-methyl
  misc_feature (13)..(13): 5-methyl
aagauggcauuuc

SEQ ID NO: 649 - RNA, 12 nt, Artificial Sequence
  Description of Artificial Sequence: Synthetic Antisense oligonucleotide
  misc_feature (8)..(8): 5-methyl
aagauggcauuu

SEQ ID NO: 650 - RNA, 11 nt, Artificial Sequence
  Description of Artificial Sequence: Synthetic Antisense oligonucleotide
  misc_feature (8)..(8): 5-methyl
aagauggcauu

SEQ ID NO: 651 - RNA, 10 nt, Artificial Sequence
  Description of Artificial Sequence: Synthetic Antisense oligonucleotide
  misc_feature (8)..(8): 5-methyl
aagauggcau

SEQ ID NO: 652 - RNA, 9 nt, Artificial Sequence
  Description of Artificial Sequence: Synthetic Antisense oligonucleotide
  misc_feature (8)..(8): 5-methyl
aagauggca

SEQ ID NO: 653 - RNA, 8 nt, Artificial Sequence
  Description of Artificial Sequence: Synthetic Antisense oligonucleotide
  misc_feature (8)..(8): 5-methyl
aagauggc

SEQ ID NO: 654 - RNA, 15 nt, Artificial Sequence
  Description of Artificial Sequence: Synthetic Antisense oligonucleotide
  misc_feature (7)..(7): 5-methyl
  misc_feature (12)..(12): 5-methyl
agauggcauuucuag

SEQ ID NO: 655 - RNA, 14 nt, Artificial Sequence
  Description of Artificial Sequence: Synthetic Antisense oligonucleotide
  misc_feature (7)..(7): 5-methyl
  misc_feature (12)..(12): 5-methyl
agauggcauuucua

SEQ ID NO: 656 - RNA, 13 nt, Artificial Sequence
  Description of Artificial Sequence: Synthetic Antisense oligonucleotide
  misc_feature (7)..(7): 5-methyl
  misc_feature (12)..(12): 5-methyl
agauggcauuucu

SEQ ID NO: 657 - RNA, 12 nt, Artificial Sequence
  Description of Artificial Sequence: Synthetic Antisense oligonucleotide
  misc_feature (7)..(7): 5-methyl
  misc_feature (12)..(12): 5-methyl
agauggcauuuc

SEQ ID NO: 658 - RNA, 11 nt, Artificial Sequence
  Description of Artificial Sequence: Synthetic Antisense oligonucleotide
  misc_feature (7)..(7): 5-methyl
agauggcauuu

SEQ ID NO: 659 - RNA, 10 nt, Artificial Sequence
  Description of Artificial Sequence: Synthetic Antisense oligonucleotide
  misc_feature (7)..(7): 5-methyl
agauggcauu

SEQ ID NO: 660 - RNA, 9 nt, Artificial Sequence
  Description of Artificial Sequence: Synthetic Antisense oligonucleotide
  misc_feature (7)..(7): 5-methyl
agauggcau

SEQ ID NO: 661 - RNA, 8 nt, Artificial Sequence
  Description of Artificial Sequence: Synthetic Antisense oligonucleotide
  misc_feature (7)..(7): 5-methyl
agauggca

SEQ ID NO: 662 - RNA, 30 nt, Artificial Sequence; identical to SEQ ID NO: 287
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl

SEQ ID NO: 663 - RNA, 29 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
cuccaacaucaaggaagauggcauuucua

SEQ ID NO: 664 - RNA, 28 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
cuccaacaucaaggaagauggcauuucu

SEQ ID NO: 665 - RNA, 27 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
cuccaacaucaaggaagauggcauuuc

SEQ ID NO: 666 - RNA, 26 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
cuccaacaucaaggaagauggcauuu

SEQ ID NO: 667 - RNA, 25 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
cuccaacaucaaggaagauggcauu

SEQ ID NO: 668 - RNA, 24 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
cuccaacaucaaggaagauggcau

SEQ ID NO: 669 - RNA, 23 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
cuccaacaucaaggaagauggca

SEQ ID NO: 670 - RNA, 22 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
cuccaacaucaaggaagauggc

SEQ ID NO: 671 - RNA, 21 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
cuccaacaucaaggaagaugg

SEQ ID NO: 672 - RNA, 20 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
cuccaacaucaaggaagaug

SEQ ID NO: 673 - RNA, 19 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
cuccaacaucaaggaagau

SEQ ID NO: 674 - RNA, 18 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
cuccaacaucaaggaaga

SEQ ID NO: 675 - RNA, 17 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
cuccaacaucaaggaag

SEQ ID NO: 676 - RNA, 29 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
uccaacaucaaggaagauggcauuucuag

SEQ ID NO: 677 - RNA, 28 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
uccaacaucaaggaagauggcauuucua

SEQ ID NO: 678 - RNA, 27 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
uccaacaucaaggaagauggcauuucu

SEQ ID NO: 679 - RNA, 26 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
uccaacaucaaggaagauggcauuuc

SEQ ID NO: 680 - RNA, 25 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
uccaacaucaaggaagauggcauuu

SEQ ID NO: 681 - RNA, 24 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
uccaacaucaaggaagauggcauu

SEQ ID NO: 682 - RNA, 23 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
uccaacaucaaggaagauggcau

SEQ ID NO: 683 - RNA, 22 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
uccaacaucaaggaagauggca

SEQ ID NO: 684 - RNA, 21 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
uccaacaucaaggaagauggc

SEQ ID NO: 685 - RNA, 20 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
uccaacaucaaggaagaugg

SEQ ID NO: 686 - RNA, 19 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
uccaacaucaaggaagaug

SEQ ID NO: 687 - RNA, 18 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
uccaacaucaaggaagau

SEQ ID NO: 688 - RNA, 17 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
uccaacaucaaggaaga

SEQ ID NO: 689 - RNA, 16 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
uccaacaucaaggaag

SEQ ID NO: 690 - RNA, 28 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
ccaacaucaaggaagauggcauuucuag

SEQ ID NO: 691 - RNA, 27 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
ccaacaucaaggaagauggcauuucua

SEQ ID NO: 692 - RNA, 26 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
ccaacaucaaggaagauggcauuucu

SEQ ID NO: 693 - RNA, 25 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
ccaacaucaaggaagauggcauuuc

SEQ ID NO: 694 - RNA, 24 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
ccaacaucaaggaagauggcauuu

SEQ ID NO: 695 - RNA, 23 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
ccaacaucaaggaagauggcauu

SEQ ID NO: 696 - RNA, 22 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
ccaacaucaaggaagauggcau

SEQ ID NO: 697 - RNA, 21 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
ccaacaucaaggaagauggca

SEQ ID NO: 698 - RNA, 20 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
ccaacaucaaggaagauggc

SEQ ID NO: 699 - RNA, 19 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
ccaacaucaaggaagaugg

SEQ ID NO: 700 - RNA, 18 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
ccaacaucaaggaagaug

SEQ ID NO: 701 - RNA, 17 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
ccaacaucaaggaagau

SEQ ID NO: 702 - RNA, 16 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
ccaacaucaaggaaga

SEQ ID NO: 703 - RNA, 15 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
ccaacaucaaggaag

SEQ ID NO: 704 - RNA, 27 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
caacaucaaggaagauggcauuucuag

SEQ ID NO: 705 - RNA, 26 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
caacaucaaggaagauggcauuucua

SEQ ID NO: 706 - RNA, 25 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
caacaucaaggaagauggcauuucu

SEQ ID NO: 707 - RNA, 24 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
caacaucaaggaagauggcauuuc

SEQ ID NO: 708 - RNA, 23 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
caacaucaaggaagauggcauuu

SEQ ID NO: 709 - RNA, 22 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
caacaucaaggaagauggcauu

SEQ ID NO: 710 - RNA, 21 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
caacaucaaggaagauggcau

SEQ ID NO: 711 - RNA, 20 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
caacaucaaggaagauggca

SEQ ID NO: 712 - RNA, 19 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
caacaucaaggaagauggc

SEQ ID NO: 713 - RNA, 18 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
caacaucaaggaagaugg

SEQ ID NO: 714 - RNA, 17 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
caacaucaaggaagaug

SEQ ID NO: 715 - RNA, 16 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
caacaucaaggaagau

SEQ ID NO: 716 - RNA, 15 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
caacaucaaggaaga

SEQ ID NO: 717 - RNA, 14 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
caacaucaaggaag

SEQ ID NO: 718 - RNA, 26 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuucuag

SEQ ID NO: 719 - RNA, 25 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuucua

SEQ ID NO: 720 - RNA, 24 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuucu

SEQ ID NO: 721 - RNA, 23 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuuc

SEQ ID NO: 722 - RNA, 22 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
aacaucaaggaagauggcauuu

SEQ ID NO: 723 - RNA, 21 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
aacaucaaggaagauggcauu

SEQ ID NO: 724 - RNA, 20 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
aacaucaaggaagauggcau

SEQ ID NO: 725 - RNA, 19 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
aacaucaaggaagauggca

SEQ ID NO: 726 - RNA, 18 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
aacaucaaggaagauggc

SEQ ID NO: 727 - RNA, 17 nt, Artificial Sequence
  Description of Artificial Sequence: Synthetic Antisense oligonucleotide
  misc_feature (3)..(3): 5-methyl
  misc_feature (6)..(6): 5-methyl
aacaucaaggaagaugg

SEQ ID NO: 728 - RNA, 16 nt, Artificial Sequence
  Description of Artificial Sequence: Synthetic Antisense oligonucleotide
  misc_feature (3)..(3): 5-methyl
  misc_feature (6)..(6): 5-methyl
aacaucaaggaagaug

SEQ ID NO: 729 - RNA, 15 nt, Artificial Sequence
  Description of Artificial Sequence: Synthetic Antisense oligonucleotide
  misc_feature (3)..(3): 5-methyl
  misc_feature (6)..(6): 5-methyl
aacaucaaggaagau

SEQ ID NO: 730 - RNA, 14 nt, Artificial Sequence
  Description of Artificial Sequence: Synthetic Antisense oligonucleotide
  misc_feature (3)..(3): 5-methyl
  misc_feature (6)..(6): 5-methyl
aacaucaaggaaga

SEQ ID NO: 731 - RNA, 13 nt, Artificial Sequence
  Description of Artificial Sequence: Synthetic Antisense oligonucleotide
  misc_feature (3)..(3): 5-methyl
  misc_feature (6)..(6): 5-methyl
aacaucaaggaag

SEQ ID NO: 732 - RNA, 25 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuucuag

SEQ ID NO: 733 - RNA, 24 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuucua

SEQ ID NO: 734 - RNA, 23 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuucu

SEQ ID NO: 735 - RNA, 22 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuuc

SEQ ID NO: 736 - RNA, 21 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
acaucaaggaagauggcauuu

SEQ ID NO: 737 - RNA, 20 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
acaucaaggaagauggcauu

SEQ ID NO: 738 - RNA, 19 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
acaucaaggaagauggcau

SEQ ID NO: 739 - RNA, 18 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
acaucaaggaagauggca

SEQ ID NO: 740 - RNA, 17 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
acaucaaggaagauggc

SEQ ID NO: 741 - RNA, 16 nt, Artificial Sequence
  Description of Artificial Sequence: Synthetic Antisense oligonucleotide
  misc_feature (2)..(2): 5-methyl
  misc_feature (5)..(5): 5-methyl
acaucaaggaagaugg

SEQ ID NO: 742 - RNA, 15 nt, Artificial Sequence
  Description of Artificial Sequence: Synthetic Antisense oligonucleotide
  misc_feature (2)..(2): 5-methyl
  misc_feature (5)..(5): 5-methyl
acaucaaggaagaug

SEQ ID NO: 743 - RNA, 14 nt, Artificial Sequence
  Description of Artificial Sequence: Synthetic Antisense oligonucleotide
  misc_feature (2)..(2): 5-methyl
  misc_feature (5)..(5): 5-methyl
acaucaaggaagau

SEQ ID NO: 744 - RNA, 13 nt, Artificial Sequence
  Description of Artificial Sequence: Synthetic Antisense oligonucleotide
  misc_feature (2)..(2): 5-methyl
  misc_feature (5)..(5): 5-methyl
acaucaaggaaga

SEQ ID NO: 745 - RNA, 12 nt, Artificial Sequence
  Description of Artificial Sequence: Synthetic Antisense oligonucleotide
  misc_feature (2)..(2): 5-methyl
  misc_feature (5)..(5): 5-methyl
acaucaaggaag

SEQ ID NO: 746 - RNA, 24 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
caucaaggaagauggcauuucuag

SEQ ID NO: 747 - RNA, 23 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
caucaaggaagauggcauuucua

SEQ ID NO: 748 - RNA, 22 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
caucaaggaagauggcauuucu

SEQ ID NO: 749 - RNA, 21 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
caucaaggaagauggcauuuc

SEQ ID NO: 750 - RNA, 20 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
caucaaggaagauggcauuu

SEQ ID NO: 751 - RNA, 19 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
caucaaggaagauggcauu

SEQ ID NO: 752 - RNA, 18 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
caucaaggaagauggcau

SEQ ID NO: 753 - RNA, 17 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
caucaaggaagauggca

SEQ ID NO: 754 - RNA, 16 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
caucaaggaagauggc

SEQ ID NO: 755 - RNA, 15 nt, Artificial Sequence
  Description of Artificial Sequence: Synthetic Antisense oligonucleotide
  misc_feature (1)..(1): 5-methyl
  misc_feature (4)..(4): 5-methyl
caucaaggaagaugg

SEQ ID NO: 756 - RNA, 14 nt, Artificial Sequence
  Description of Artificial Sequence: Synthetic Antisense oligonucleotide
  misc_feature (1)..(1): 5-methyl
  misc_feature (4)..(4): 5-methyl
caucaaggaagaug

SEQ ID NO: 757 - RNA, 13 nt, Artificial Sequence
  Description of Artificial Sequence: Synthetic Antisense oligonucleotide
  misc_feature (1)..(1): 5-methyl
  misc_feature (4)..(4): 5-methyl
caucaaggaagau

SEQ ID NO: 758 - RNA, 12 nt, Artificial Sequence
  Description of Artificial Sequence: Synthetic Antisense oligonucleotide
  misc_feature (1)..(1): 5-methyl
  misc_feature (4)..(4): 5-methyl
caucaaggaaga

SEQ ID NO: 759 - RNA, 11 nt, Artificial Sequence
  Description of Artificial Sequence: Synthetic Antisense oligonucleotide
  misc_feature (1)..(1): 5-methyl
  misc_feature (4)..(4): 5-methyl
caucaaggaag

SEQ ID NO: 760 - RNA, 23 nt, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
aucaaggaagauggcauuucuag

SEQ ID NO: 761 - RNA, 22 nt, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
aucaaggaagauggcauuucua

SEQ ID NO: 762 - RNA, 21 nt, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
aucaaggaagauggcauuucu

SEQ ID NO: 763 - RNA, 20 nt, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
aucaaggaagauggcauuuc

SEQ ID NO: 764 - RNA, 19 nt, Artificial Sequence
  Description of Artificial Sequence: Synthetic Antisense oligonucleotide
  misc_feature (3)..(3): 5-methyl
  misc_feature (15)..(15): 5-methyl
aucaaggaagauggcauuu

SEQ ID NO: 765 - RNA, 18 nt, Artificial Sequence
  Description of Artificial Sequence: Synthetic Antisense oligonucleotide
  misc_feature (3)..(3): 5-methyl
  misc_feature (15)..(15): 5-methyl
aucaaggaagauggcauu

SEQ ID NO: 766 - RNA, 17 nt, Artificial Sequence
  Description of Artificial Sequence: Synthetic Antisense oligonucleotide
  misc_feature (3)..(3): 5-methyl
  misc_feature (15)..(15): 5-methyl
aucaaggaagauggcau

SEQ ID NO: 767 - RNA, 16 nt, Artificial Sequence
  Description of Artificial Sequence: Synthetic Antisense oligonucleotide
  misc_feature (3)..(3): 5-methyl
  misc_feature (15)..(15): 5-methyl
aucaaggaagauggca

SEQ ID NO: 768 - RNA, 15 nt, Artificial Sequence
  Description of Artificial Sequence: Synthetic Antisense oligonucleotide
  misc_feature (3)..(3): 5-methyl
  misc_feature (15)..(15): 5-methyl
aucaaggaagauggc

SEQ ID NO: 769 - RNA, 14 nt, Artificial Sequence
  Description of Artificial Sequence: Synthetic Antisense oligonucleotide
  misc_feature (3)..(3): 5-methyl
aucaaggaagaugg

SEQ ID NO: 770 - RNA, 13 nt, Artificial Sequence
  Description of Artificial Sequence: Synthetic Antisense oligonucleotide
  misc_feature (3)..(3): 5-methyl
aucaaggaagaug

SEQ ID NO: 771 - RNA, 12 nt, Artificial Sequence
  Description of Artificial Sequence: Synthetic Antisense oligonucleotide
  misc_feature (3)..(3): 5-methyl
aucaaggaagau

SEQ ID NO: 772 - RNA, 11 nt, Artificial Sequence
  Description of Artificial Sequence: Synthetic Antisense oligonucleotide
  misc_feature (3)..(3): 5-methyl
aucaaggaaga

SEQ ID NO: 773 - RNA, 10 nt, Artificial Sequence
  Description of Artificial Sequence: Synthetic Antisense oligonucleotide
  misc_feature (3)..(3): 5-methyl
aucaaggaag

SEQ ID NO: 774 - DNA, 18 bp, Artificial Sequence
  Description of Artificial Sequence: Synthetic Antisense oligonucleotide
ggtaagttctgtccaagc

SEQ ID NO: 775 - DNA, 18 bp, Artificial Sequence
  Description of Artificial Sequence: Synthetic Antisense oligonucleotide
gtaagttctgtccaagcc

SEQ ID NO: 776 - DNA, 18 bp, Artificial Sequence
  Description of Artificial Sequence: Synthetic Antisense oligonucleotide
agtcggtaagttctgtcc

SEQ ID NO: 777 - DNA, 18 bp, Artificial Sequence
  Description of Artificial Sequence: Synthetic Antisense oligonucleotide
ctgtccaagcccggttga

SEQ ID NO: 778 - DNA, 15 bp, Artificial Sequence
  Description of Artificial Sequence: Synthetic Antisense oligonucleotide
taagttctgtccaag

SEQ ID NO: 779 - DNA, 20 bp, Artificial Sequence
  Description of Artificial Sequence: Synthetic Antisense oligonucleotide
ttctgtccaagcccggttga

SEQ ID NO: 780 - DNA, 19 bp, Artificial Sequence
  Description of Artificial Sequence: Synthetic Antisense oligonucleotide
ttctgtccaagcccggttg

SEQ ID NO: 781 - DNA, 18 bp, Artificial Sequence
  Description of Artificial Sequence: Synthetic Antisense oligonucleotide
ttctgtccaagcccggtt

SEQ ID NO: 782 - DNA, 17 bp, Artificial Sequence
  Description of Artificial Sequence: Synthetic Antisense oligonucleotide
ttctgtccaagcccggt

SEQ ID NO: 783 - DNA, 16 bp, Artificial Sequence
  Description of Artificial Sequence: Synthetic Antisense oligonucleotide
ttctgtccaagcccgg

SEQ ID NO: 784 - DNA, 15 bp, Artificial Sequence
  Description of Artificial Sequence: Synthetic Antisense oligonucleotide
ttctgtccaagcccg

SEQ ID NO: 785 - DNA, 14 bp, Artificial Sequence
  Description of Artificial Sequence: Synthetic Antisense oligonucleotide
ttctgtccaagccc

SEQ ID NO: 786 - DNA, 13 bp, Artificial Sequence
  Description of Artificial Sequence: Synthetic Antisense oligonucleotide
ttctgtccaagcc

SEQ ID NO: 787 - DNA, 12 bp, Artificial Sequence
  Description of Artificial Sequence: Synthetic Antisense oligonucleotide
ttctgtccaagc

SEQ ID NO: 788 - DNA, 11 bp, Artificial Sequence
  Description of Artificial Sequence: Synthetic Antisense oligonucleotide
ttctgtccaag

SEQ ID NO: 789 - DNA, 10 bp, Artificial Sequence
  Description of Artificial Sequence: Synthetic Antisense oligonucleotide
ttctgtccaa

SEQ ID NO: 790 - DNA, 9 bp, Artificial Sequence
  Description of Artificial Sequence: Synthetic Antisense oligonucleotide
ttctgtcca

SEQ ID NO: 791 - DNA, 8 bp, Artificial Sequence
  Description of Artificial Sequence: Synthetic Antisense oligonucleotide
ttctgtcc

SEQ ID NO: 792 - DNA, 19 bp, Artificial Sequence
  Description of Artificial Sequence: Synthetic Antisense oligonucleotide
tctgtccaagcccggttga

SEQ ID NO: 793 - DNA, 18 bp, Artificial Sequence
  Description of Artificial Sequence: Synthetic Antisense oligonucleotide
tctgtccaagcccggttg

SEQ ID NO: 794 - DNA, 17 bp, Artificial Sequence
  Description of Artificial Sequence: Synthetic Antisense oligonucleotide
tctgtccaagcccggtt

SEQ ID NO: 795 - DNA, 16 bp, Artificial Sequence
  Description of Artificial Sequence: Synthetic Antisense oligonucleotide
tctgtccaagcccggt

SEQ ID NO: 796 - DNA, 15 bp, Artificial Sequence
  Description of Artificial Sequence: Synthetic Antisense oligonucleotide
tctgtccaagcccgg

SEQ ID NO: 797 - DNA, 14 bp, Artificial Sequence
  Description of Artificial Sequence: Synthetic Antisense oligonucleotide
tctgtccaagcccg

SEQ ID NO: 798 - DNA, 13 bp, Artificial Sequence
  Description of Artificial Sequence: Synthetic Antisense oligonucleotide
tctgtccaagccc

SEQ ID NO: 799 - DNA, 12 bp, Artificial Sequence
  Description of Artificial Sequence: Synthetic Antisense oligonucleotide
tctgtccaagcc

SEQ ID NO: 800 - DNA, 11 bp, Artificial Sequence
  Description of Artificial Sequence: Synthetic Antisense oligonucleotide
tctgtccaagc

SEQ ID NO: 801 - DNA, 10 bp, Artificial Sequence
  Description of Artificial Sequence: Synthetic Antisense oligonucleotide
tctgtccaag

SEQ ID NO: 802 - DNA, 9 bp, Artificial Sequence
  Description of Artificial Sequence: Synthetic Antisense oligonucleotide
tctgtccaa

SEQ ID NO: 803 - DNA, 8 bp, Artificial Sequence
  Description of Artificial Sequence: Synthetic Antisense oligonucleotide
tctgtcca

SEQ ID NO: 804 - DNA, 17 bp, Artificial Sequence
  Description of Artificial Sequence: Synthetic Antisense oligonucleotide
ctgtccaagcccggttg

SEQ ID NO: 805 - DNA, 16 bp, Artificial Sequence
  Description of Artificial Sequence: Synthetic Antisense oligonucleotide
ctgtccaagcccggtt

SEQ ID NO: 806 - DNA, 15 bp, Artificial Sequence
  Description of Artificial Sequence: Synthetic Antisense oligonucleotide
ctgtccaagcccggt

SEQ ID NO: 807 - DNA, 14 bp, Artificial Sequence
  Description of Artificial Sequence: Synthetic Antisense oligonucleotide
ctgtccaagcccgg

SEQ ID NO: 808 - DNA, 13 bp, Artificial Sequence
  Description of Artificial Sequence: Synthetic Antisense oligonucleotide
ctgtccaagcccg

SEQ ID NO: 809 - DNA, 12 bp, Artificial Sequence
  Description of Artificial Sequence: Synthetic Antisense oligonucleotide
ctgtccaagccc

SEQ ID NO: 810 - DNA, 11 bp, Artificial Sequence
  Description of Artificial Sequence: Synthetic Antisense oligonucleotide
ctgtccaagcc

SEQ ID NO: 811 - DNA, 10 bp, Artificial Sequence
  Description of Artificial Sequence: Synthetic Antisense oligonucleotide
ctgtccaagc

SEQ ID NO: 812 - DNA, 9 bp, Artificial Sequence
  Description of Artificial Sequence: Synthetic Antisense oligonucleotide
ctgtccaag

SEQ ID NO: 813 - DNA, 8 bp, Artificial Sequence
  Description of Artificial Sequence: Synthetic Antisense oligonucleotide
ctgtccaa

SEQ ID NO: 814 - DNA, 20 bp, Artificial Sequence
  Description of Artificial Sequence: Synthetic Antisense oligonucleotide
gttctgtccaagcccggttg

SEQ ID NO: 815 - DNA, 19 bp, Artificial Sequence
  Description of Artificial Sequence: Synthetic Antisense oligonucleotide
gttctgtccaagcccggtt

SEQ ID NO: 816 - DNA, 18 bp, Artificial Sequence
  Description of Artificial Sequence: Synthetic Antisense oligonucleotide
gttctgtccaagcccggt

SEQ ID NO: 817 - DNA, 17 bp, Artificial Sequence
  Description of Artificial Sequence: Synthetic Antisense oligonucleotide
gttctgtccaagcccgg

SEQ ID NO: 818 - DNA, 16 bp, Artificial Sequence
  Description of Artificial Sequence: Synthetic Antisense oligonucleotide
gttctgtccaagcccg

SEQ ID NO: 819 - DNA, 15 bp, Artificial Sequence
  Description of Artificial Sequence: Synthetic Antisense oligonucleotide
gttctgtccaagccc

SEQ ID NO: 820 - DNA, 14 bp, Artificial Sequence
  Description of Artificial Sequence: Synthetic Antisense oligonucleotide
gttctgtccaagcc

SEQ ID NO: 821 - DNA, 13 bp, Artificial Sequence
  Description of Artificial Sequence: Synthetic Antisense oligonucleotide
gttctgtccaagc

SEQ ID NO: 822 - DNA, 12 bp, Artificial Sequence
  Description of Artificial Sequence: Synthetic Antisense oligonucleotide
gttctgtccaag

SEQ ID NO: 823 - DNA, 11 bp, Artificial Sequence
  Description of Artificial Sequence: Synthetic Antisense oligonucleotide
gttctgtccaa

SEQ ID NO: 824 - DNA, 10 bp, Artificial Sequence
  Description of Artificial Sequence: Synthetic Antisense oligonucleotide
gttctgtcca

SEQ ID NO: 825 - DNA, 9 bp, Artificial Sequence
  Description of Artificial Sequence: Synthetic Antisense oligonucleotide
gttctgtcc

SEQ ID NO: 826 - DNA, 8 bp, Artificial Sequence
  Description of Artificial Sequence: Synthetic Antisense oligonucleotide
gttctgtc

SEQ ID NO: 827 - DNA, 20 bp, Artificial Sequence
  Description of Artificial Sequence: Synthetic Antisense oligonucleotide
agttctgtccaagcccggtt

SEQ ID NO: 828 - DNA, 19 bp, Artificial Sequence
  Description of Artificial Sequence: Synthetic Antisense oligonucleotide
agttctgtccaagcccggt

SEQ ID NO: 829 - DNA, 18 bp, Artificial Sequence
  Description of Artificial Sequence: Synthetic Antisense oligonucleotide
agttctgtccaagcccgg

SEQ ID NO: 830 - DNA, 17 bp, Artificial Sequence
  Description of Artificial Sequence: Synthetic Antisense oligonucleotide
agttctgtccaagcccg

SEQ ID NO: 831 - DNA, 16 bp, Artificial Sequence
  Description of Artificial Sequence: Synthetic Antisense oligonucleotide
agttctgtccaagccc

SEQ ID NO: 832 - DNA, 15 bp, Artificial Sequence
  Description of Artificial Sequence: Synthetic Antisense oligonucleotide
agttctgtccaagcc

SEQ ID NO: 833 - DNA, 14 bp, Artificial Sequence
  Description of Artificial Sequence: Synthetic Antisense oligonucleotide
agttctgtccaagc

SEQ ID NO: 834 - DNA, 13 bp, Artificial Sequence
  Description of Artificial Sequence: Synthetic Antisense oligonucleotide
agttctgtccaag

SEQ ID NO: 835 - DNA, 12 bp, Artificial Sequence
  Description of Artificial Sequence: Synthetic Antisense oligonucleotide
agttctgtccaa

SEQ ID NO: 836 - DNA, 11 bp, Artificial Sequence
  Description of Artificial Sequence: Synthetic Antisense oligonucleotide
agttctgtcca

SEQ ID NO: 837 - DNA, 10 bp, Artificial Sequence
  Description of Artificial Sequence: Synthetic Antisense oligonucleotide
agttctgtcc

SEQ ID NO: 838 - DNA, 9 bp, Artificial Sequence
  Description of Artificial Sequence: Synthetic Antisense oligonucleotide
agttctgtc

SEQ ID NO: 839 - DNA, 8 bp, Artificial Sequence
  Description of Artificial Sequence: Synthetic Antisense oligonucleotide
agttctgt

SEQ ID NO: 840 - DNA, 20 bp, Artificial Sequence
  Description of Artificial Sequence: Synthetic Antisense oligonucleotide
aagttctgtccaagcccggt

SEQ ID NO: 841 - DNA, 19 bp, Artificial Sequence
  Description of Artificial Sequence: Synthetic Antisense oligonucleotide
aagttctgtccaagcccgg

SEQ ID NO: 842 - DNA, 18 bp, Artificial Sequence
  Description of Artificial Sequence: Synthetic Antisense oligonucleotide
aagttctgtccaagcccg

SEQ ID NO: 843 - DNA, 17 bp, Artificial Sequence
  Description of Artificial Sequence: Synthetic Antisense oligonucleotide
aagttctgtccaagccc

SEQ ID NO: 844 - DNA, 16 bp, Artificial Sequence
  Description of Artificial Sequence: Synthetic Antisense oligonucleotide
aagttctgtccaagcc

SEQ ID NO: 845 - DNA, 15 bp, Artificial Sequence
  Description of Artificial Sequence: Synthetic Antisense oligonucleotide
aagttctgtccaagc

SEQ ID NO: 846 - DNA, 14 bp, Artificial Sequence
  Description of Artificial Sequence: Synthetic Antisense oligonucleotide
aagttctgtccaag

SEQ ID NO: 847 - DNA, 13 bp, Artificial Sequence
  Description of Artificial Sequence: Synthetic Antisense oligonucleotide
aagttctgtccaa

SEQ ID NO: 848 - DNA, 12 bp, Artificial Sequence
  Description of Artificial Sequence: Synthetic Antisense oligonucleotide
aagttctgtcca

SEQ ID NO: 849 - DNA, 11 bp, Artificial Sequence
  Description of Artificial Sequence: Synthetic Antisense oligonucleotide
aagttctgtcc

SEQ ID NO: 850 - DNA, 10 bp, Artificial Sequence
  Description of Artificial Sequence: Synthetic Antisense oligonucleotide
aagttctgtc

SEQ ID NO: 851 - DNA, 9 bp, Artificial Sequence
  Description of Artificial Sequence: Synthetic Antisense oligonucleotide
aagttctgt

SEQ ID NO: 852 - DNA, 8 bp, Artificial Sequence
  Description of Artificial Sequence: Synthetic Antisense oligonucleotide
aagttctg

SEQ ID NO: 853 - DNA, 20 bp, Artificial Sequence
  Description of Artificial Sequence: Synthetic Antisense oligonucleotide
taagttctgtccaagcccgg

SEQ ID NO: 854 - DNA, 19 bp, Artificial Sequence
  Description of Artificial Sequence: Synthetic Antisense oligonucleotide
taagttctgtccaagcccg

SEQ ID NO: 855 - DNA, 18 bp, Artificial Sequence
  Description of Artificial Sequence: Synthetic Antisense oligonucleotide
taagttctgtccaagccc

SEQ ID NO: 856 - DNA, 17 bp, Artificial Sequence
  Description of Artificial Sequence: Synthetic Antisense oligonucleotide
taagttctgtccaagcc

SEQ ID NO: 857 - DNA, 16 bp, Artificial Sequence
  Description of Artificial Sequence: Synthetic Antisense oligonucleotide
taagttctgtccaagc

SEQ ID NO: 858 - DNA, 14 bp, Artificial Sequence
  Description of Artificial Sequence: Synthetic Antisense oligonucleotide
taagttctgtccaa

SEQ ID NO: 859 - DNA, 13 bp, Artificial Sequence
  Description of Artificial Sequence: Synthetic Antisense oligonucleotide
taagttctgtcca

SEQ ID NO: 860 - DNA, 12 bp, Artificial Sequence
  Description of Artificial Sequence: Synthetic Antisense oligonucleotide
taagttctgtcc

SEQ ID NO: 861 - DNA, 11 bp, Artificial Sequence
  Description of Artificial Sequence: Synthetic Antisense oligonucleotide
taagttctgtc

SEQ ID NO: 862 - DNA, 10 bp, Artificial Sequence
  Description of Artificial Sequence: Synthetic Antisense oligonucleotide
taagttctgt

SEQ ID NO: 863 - DNA, 9 bp, Artificial Sequence
  Description of Artificial Sequence: Synthetic Antisense oligonucleotide
taagttctg

SEQ ID NO: 864 - DNA, 8 bp, Artificial Sequence
  Description of Artificial Sequence: Synthetic Antisense oligonucleotide
taagttct

SEQ ID NO: 865 - DNA, 20 bp, Artificial Sequence
  Description of Artificial Sequence: Synthetic Antisense oligonucleotide
gtaagttctgtccaagcccg

SEQ ID NO: 866 - DNA, 19 bp, Artificial Sequence
  Description of Artificial Sequence: Synthetic Antisense oligonucleotide
gtaagttctgtccaagccc

SEQ ID NO: 867 - DNA, 17 bp, Artificial Sequence
  Description of Artificial Sequence: Synthetic Antisense oligonucleotide
gtaagttctgtccaagc

SEQ ID NO: 868 - DNA, 16 bp, Artificial Sequence
  Description of Artificial Sequence: Synthetic Antisense oligonucleotide
gtaagttctgtccaag

SEQ ID NO: 869 - DNA, 15 bp, Artificial Sequence
  Description of Artificial Sequence: Synthetic Antisense oligonucleotide
gtaagttctgtccaa

SEQ ID NO: 870 - DNA, 14 bp, Artificial Sequence
  Description of Artificial Sequence: Synthetic Antisense oligonucleotide
gtaagttctgtcca

SEQ ID NO: 871 - DNA, 13 bp, Artificial Sequence
  Description of Artificial Sequence: Synthetic Antisense oligonucleotide
gtaagttctgtcc

SEQ ID NO: 872 - DNA, 12 bp, Artificial Sequence
  Description of Artificial Sequence: Synthetic Antisense oligonucleotide
gtaagttctgtc

SEQ ID NO: 873 - DNA, 11 bp, Artificial Sequence
  Description of Artificial Sequence: Synthetic Antisense oligonucleotide
gtaagttctgt

SEQ ID NO: 874 - DNA, 10 bp, Artificial Sequence
  Description of Artificial Sequence: Synthetic Antisense oligonucleotide
gtaagttctg

SEQ ID NO: 875 - DNA, 9 bp, Artificial Sequence
  Description of Artificial Sequence: Synthetic Antisense oligonucleotide
gtaagttct

SEQ ID NO: 876 - DNA, 8 bp, Artificial Sequence
  Description of Artificial Sequence: Synthetic Antisense oligonucleotide
gtaagttc

SEQ ID NO: 877 - DNA, 20 bp, Artificial Sequence
  Description of Artificial Sequence: Synthetic Antisense oligonucleotide
ggtaagttctgtccaagccc

SEQ ID NO: 878 - DNA, 19 bp, Artificial Sequence
  Description of Artificial Sequence: Synthetic Antisense oligonucleotide
ggtaagttctgtccaagcc

SEQ ID NO: 879 - DNA, 17 bp, Artificial Sequence
  Description of Artificial Sequence: Synthetic Antisense oligonucleotide
ggtaagttctgtccaag

SEQ ID NO: 880 - DNA, 16 bp, Artificial Sequence
  Description of Artificial Sequence: Synthetic Antisense oligonucleotide
ggtaagttctgtccaa

SEQ ID NO: 881 - DNA, 15 bp, Artificial Sequence
  Description of Artificial Sequence: Synthetic Antisense oligonucleotide
ggtaagttctgtcca

SEQ ID NO: 882 - DNA, 14 bp, Artificial Sequence
  Description of Artificial Sequence: Synthetic Antisense oligonucleotide
ggtaagttctgtcc

SEQ ID NO: 883 - DNA, 13 bp, Artificial Sequence
  Description of Artificial Sequence: Synthetic Antisense oligonucleotide
ggtaagttctgtc

SEQ ID NO: 884 - DNA, 12 bp, Artificial Sequence
  Description of Artificial Sequence: Synthetic Antisense oligonucleotide
ggtaagttctgt

SEQ ID NO: 885 - DNA, 11 bp, Artificial Sequence
  Description of Artificial Sequence: Synthetic Antisense oligonucleotide
ggtaagttctg

SEQ ID NO: 886 - DNA, 10 bp, Artificial Sequence
  Description of Artificial Sequence: Synthetic Antisense oligonucleotide
ggtaagttct

SEQ ID NO: 887 - DNA, 9 bp, Artificial Sequence
  Description of Artificial Sequence: Synthetic Antisense oligonucleotide
ggtaagttc

SEQ ID NO: 888 - DNA, 8 bp, Artificial Sequence
  Description of Artificial Sequence: Synthetic Antisense oligonucleotide
ggtaagtt

SEQ ID NO: 889 - DNA, 20 bp, Artificial Sequence
  Description of Artificial Sequence: Synthetic Antisense oligonucleotide
cggtaagttctgtccaagcc

SEQ ID NO: 890 - DNA, 19 bp, Artificial Sequence
  Description of Artificial Sequence: Synthetic Antisense oligonucleotide
cggtaagttctgtccaagc

SEQ ID NO: 891 - DNA, 18 bp, Artificial Sequence
  Description of Artificial Sequence: Synthetic Antisense oligonucleotide
cggtaagttctgtccaag

SEQ ID NO: 892 - DNA, 17 bp, Artificial Sequence
  Description of Artificial Sequence: Synthetic Antisense oligonucleotide
cggtaagttctgtccaa

SEQ ID NO: 893 - DNA, 16 bp, Artificial Sequence
  Description of Artificial Sequence: Synthetic Antisense oligonucleotide
cggtaagttctgtcca

SEQ ID NO: 894 - DNA, 15 bp, Artificial Sequence
  Description of Artificial Sequence: Synthetic Antisense oligonucleotide
cggtaagttctgtcc

SEQ ID NO: 895 - DNA, 14 bp, Artificial Sequence
  Description of Artificial Sequence: Synthetic Antisense oligonucleotide
cggtaagttctgtc

SEQ ID NO: 896 - DNA, 13 bp, Artificial Sequence
  Description of Artificial Sequence: Synthetic Antisense oligonucleotide
cggtaagttctgt

SEQ ID NO: 897 - DNA, 12 bp, Artificial Sequence
  Description of Artificial Sequence: Synthetic Antisense oligonucleotide
cggtaagttctg

SEQ ID NO: 898 - DNA, 11 bp, Artificial Sequence
  Description of Artificial Sequence: Synthetic Antisense oligonucleotide
cggtaagttct

SEQ ID NO: 899 - DNA, 10 bp, Artificial Sequence
  Description of Artificial Sequence: Synthetic Antisense oligonucleotide
cggtaagttc

SEQ ID NO: 900 - DNA, 9 bp, Artificial Sequence
  Description of Artificial Sequence: Synthetic Antisense oligonucleotide
cggtaagtt

SEQ ID NO: 901 - DNA, 8 bp, Artificial Sequence
  Description of Artificial Sequence: Synthetic Antisense oligonucleotide
cggtaagt

SEQ ID NO: 902 - DNA, 20 bp, Artificial Sequence
  Description of Artificial Sequence: Synthetic Antisense oligonucleotide
tcggtaagttctgtccaagc

SEQ ID NO: 903 - DNA, 19 bp, Artificial Sequence
  Description of Artificial Sequence: Synthetic Antisense oligonucleotide
tcggtaagttctgtccaag

SEQ ID NO: 904 - DNA, 18 bp, Artificial Sequence
  Description of Artificial Sequence: Synthetic Antisense oligonucleotide
tcggtaagttctgtccaa

SEQ ID NO: 905 - DNA, 17 bp, Artificial Sequence
  Description of Artificial Sequence: Synthetic Antisense oligonucleotide
tcggtaagttctgtcca

SEQ ID NO: 906 - DNA, 16 bp, Artificial Sequence
  Description of Artificial Sequence: Synthetic Antisense oligonucleotide
tcggtaagttctgtcc

SEQ ID NO: 907 - DNA, 15 bp, Artificial Sequence
  Description of Artificial Sequence: Synthetic Antisense oligonucleotide
tcggtaagttctgtc

SEQ ID NO: 908 - DNA, 14 bp, Artificial Sequence
  Description of Artificial Sequence: Synthetic Antisense oligonucleotide
tcggtaagttctgt

SEQ ID NO: 909 - DNA, 13 bp, Artificial Sequence
  Description of Artificial Sequence: Synthetic Antisense oligonucleotide
tcggtaagttctg

SEQ ID NO: 910 - DNA, 12 bp, Artificial Sequence
  Description of Artificial Sequence: Synthetic Antisense oligonucleotide
tcggtaagttct

SEQ ID NO: 911 - DNA, 11 bp, Artificial Sequence
  Description of Artificial Sequence: Synthetic Antisense oligonucleotide
tcggtaagttc

SEQ ID NO: 912 - DNA, 10 bp, Artificial Sequence
  Description of Artificial Sequence: Synthetic Antisense oligonucleotide
tcggtaagtt

SEQ ID NO: 913 - DNA, 9 bp, Artificial Sequence
  Description of Artificial Sequence: Synthetic Antisense oligonucleotide
tcggtaagt

SEQ ID NO: 914 - DNA, 20 bp, Artificial Sequence
  Description of Artificial Sequence: Synthetic Antisense oligonucleotide
gtcggtaagttctgtccaag

SEQ ID NO: 915 - DNA, 19 bp, Artificial Sequence
  Description of Artificial Sequence: Synthetic Antisense oligonucleotide
gtcggtaagttctgtccaa

SEQ ID NO: 916 - DNA, 18 bp, Artificial Sequence
  Description of Artificial Sequence: Synthetic Antisense oligonucleotide
gtcggtaagttctgtcca

SEQ ID NO: 917 - DNA, 17 bp, Artificial Sequence
  Description of Artificial Sequence: Synthetic Antisense oligonucleotide
gtcggtaagttctgtcc

SEQ ID NO: 918 - DNA, 16 bp, Artificial Sequence
  Description of Artificial Sequence: Synthetic Antisense oligonucleotide
gtcggtaagttctgtc

SEQ ID NO: 919 - DNA, 15 bp, Artificial Sequence
  Description of Artificial Sequence: Synthetic Antisense oligonucleotide
gtcggtaagttctgt

SEQ ID NO: 920 - DNA, 14 bp, Artificial Sequence
  Description of Artificial Sequence: Synthetic Antisense oligonucleotide
gtcggtaagttctg

SEQ ID NO: 921 - DNA, 13 bp, Artificial Sequence
  Description of Artificial Sequence: Synthetic Antisense oligonucleotide
gtcggtaagttct

SEQ ID NO: 922 - DNA, 12 bp, Artificial Sequence
  Description of Artificial Sequence: Synthetic Antisense oligonucleotide
gtcggtaagttc

SEQ ID NO: 923 - DNA, 11 bp, Artificial Sequence
  Description of Artificial Sequence: Synthetic Antisense oligonucleotide
gtcggtaagtt

SEQ ID NO: 924 - DNA, 10 bp, Artificial Sequence
  Description of Artificial Sequence: Synthetic Antisense oligonucleotide
gtcggtaagt

SEQ ID NO: 925 - DNA, 20 bp, Artificial Sequence
  Description of Artificial Sequence: Synthetic Antisense oligonucleotide
agtcggtaagttctgtccaa

SEQ ID NO: 926 - DNA, 19 bp, Artificial Sequence
  Description of Artificial Sequence: Synthetic Antisense oligonucleotide
agtcggtaagttctgtcca

SEQ ID NO: 927 - DNA, 17 bp, Artificial Sequence
  Description of Artificial Sequence: Synthetic Antisense oligonucleotide
agtcggtaagttctgtc

SEQ ID NO: 928 - DNA, 16 bp, Artificial Sequence
  Description of Artificial Sequence: Synthetic Antisense oligonucleotide
agtcggtaagttctgt

SEQ ID NO: 929 - DNA, 15 bp, Artificial Sequence
  Description of Artificial Sequence: Synthetic Antisense oligonucleotide
agtcggtaagttctg

SEQ ID NO: 930 - DNA, 14 bp, Artificial Sequence
  Description of Artificial Sequence: Synthetic Antisense oligonucleotide
agtcggtaagttct

SEQ ID NO: 931 - DNA, 13 bp, Artificial Sequence
  Description of Artificial Sequence: Synthetic Antisense oligonucleotide
agtcggtaagttc

SEQ ID NO: 932 - DNA, 12 bp, Artificial Sequence
  Description of Artificial Sequence: Synthetic Antisense oligonucleotide
agtcggtaagtt

SEQ ID NO: 933 - DNA, 11 bp, Artificial Sequence
  Description of Artificial Sequence: Synthetic Antisense oligonucleotide
agtcggtaagt

SEQ ID NO: 934 - DNA, 20 bp, Artificial Sequence
  Description of Artificial Sequence: Synthetic Antisense oligonucleotide
cagtcggtaagttctgtcca

SEQ ID NO: 935 - DNA, 19 bp, Artificial Sequence
  Description of Artificial Sequence: Synthetic Antisense oligonucleotide
cagtcggtaagttctgtcc

SEQ ID NO: 936 - DNA, 18 bp, Artificial Sequence
  Description of Artificial Sequence: Synthetic Antisense oligonucleotide
cagtcggtaagttctgtc

SEQ ID NO: 937 - DNA, 17 bp, Artificial Sequence
  Description of Artificial Sequence: Synthetic Antisense oligonucleotide
cagtcggtaagttctgt

SEQ ID NO: 938 - DNA, 16 bp, Artificial Sequence
  Description of Artificial Sequence: Synthetic Antisense oligonucleotide
cagtcggtaagttctg

SEQ ID NO: 939 - DNA, 15 bp, Artificial Sequence
  Description of Artificial Sequence: Synthetic Antisense oligonucleotide
cagtcggtaagttct

SEQ ID NO: 940 - DNA, 14 bp, Artificial Sequence
  Description of Artificial Sequence: Synthetic Antisense oligonucleotide
cagtcggtaagttc

SEQ ID NO: 941 - DNA, 13 bp, Artificial Sequence
  Description of Artificial Sequence: Synthetic Antisense oligonucleotide
cagtcggtaagtt

SEQ ID NO: 942 - DNA, 12 bp, Artificial Sequence
  Description of Artificial Sequence: Synthetic Antisense oligonucleotide
cagtcggtaagt

SEQ ID NO: 943 - DNA, 20 bp, Artificial Sequence
  Description of Artificial Sequence: Synthetic Antisense oligonucleotide
ccagtcggtaagttctgtcc

SEQ ID NO: 944 - DNA, 19 bp, Artificial Sequence
  Description of Artificial Sequence: Synthetic Antisense oligonucleotide
ccagtcggtaagttctgtc

SEQ ID NO: 945 - DNA, 18 bp, Artificial Sequence
  Description of Artificial Sequence: Synthetic Antisense oligonucleotide
ccagtcggtaagttctgt

SEQ ID NO: 946 - DNA, 17 bp, Artificial Sequence
  Description of Artificial Sequence: Synthetic Antisense oligonucleotide
ccagtcggtaagttctg

SEQ ID NO: 947 - DNA, 16 bp, Artificial Sequence
  Description of Artificial Sequence: Synthetic Antisense oligonucleotide
ccagtcggtaagttct

SEQ ID NO: 948 - DNA, 15 bp, Artificial Sequence
  Description of Artificial Sequence: Synthetic Antisense oligonucleotide
ccagtcggtaagttc

SEQ ID NO: 949 - DNA, 14 bp, Artificial Sequence
  Description of Artificial Sequence: Synthetic Antisense oligonucleotide
ccagtcggtaagtt

SEQ ID NO: 950 - DNA, 13 bp, Artificial Sequence
  Description of Artificial Sequence: Synthetic Antisense oligonucleotide
ccagtcggtaagt

SEQ ID NO: 951 - DNA, 20 bp, Artificial Sequence
  Description of Artificial Sequence: Synthetic Antisense oligonucleotide
gccagtcggtaagttctgtc

SEQ ID NO: 952 - DNA, 19 bp, Artificial Sequence
  Description of Artificial Sequence: Synthetic Antisense oligonucleotide
gccagtcggtaagttctgt

SEQ ID NO: 953 - DNA, 18 bp, Artificial Sequence
  Description of Artificial Sequence: Synthetic Antisense oligonucleotide
gccagtcggtaagttctg

SEQ ID NO: 954 - DNA, 17 bp, Artificial Sequence
  Description of Artificial Sequence: Synthetic Antisense oligonucleotide
gccagtcggtaagttct

SEQ ID NO: 955 - DNA, 16 bp, Artificial Sequence
  Description of Artificial Sequence: Synthetic Antisense oligonucleotide
gccagtcggtaagttc

SEQ ID NO: 956 - DNA, 15 bp, Artificial Sequence
  Description of Artificial Sequence: Synthetic Antisense oligonucleotide
gccagtcggtaagtt

SEQ ID NO: 957 - DNA, 14 bp, Artificial Sequence
  Description of Artificial Sequence: Synthetic Antisense oligonucleotide
gccagtcggtaagt

SEQ ID NO: 958 - DNA, 20 bp, Artificial Sequence
  Description of Artificial Sequence: Synthetic Antisense oligonucleotide
tcaaggaagatggcatttct

SEQ ID NO: 959 - DNA, 22 bp, Artificial Sequence
  Description of Artificial Sequence: Synthetic Antisense oligonucleotide
tcaaggaagatggcatttctag

SEQ ID NO: 960 - DNA, 16 bp, Artificial Sequence
  Description of Artificial Sequence: Synthetic Antisense oligonucleotide
tcaaggaagatggcat

SEQ ID NO: 961 - DNA, 15 bp, Artificial Sequence
  Description of Artificial Sequence: Synthetic Antisense oligonucleotide
gaagatggcatttct

SEQ ID NO: 962 - DNA, 21 bp, Artificial Sequence
  Description of Artificial Sequence: Synthetic Antisense oligonucleotide
tcaaggaagatggcatttcta

SEQ ID NO: 963 - DNA, 19 bp, Artificial Sequence
  Description of Artificial Sequence: Synthetic Antisense oligonucleotide
tcaaggaagatggcatttc

SEQ ID NO: 964 - DNA, 18 bp, Artificial Sequence
  Description of Artificial Sequence: Synthetic Antisense oligonucleotide
tcaaggaagatggcattt

SEQ ID NO: 965 - DNA, 17 bp, Artificial Sequence
  Description of Artificial Sequence: Synthetic Antisense oligonucleotide
tcaaggaagatggcatt

SEQ ID NO: 966 - DNA, 15 bp, Artificial Sequence
  Description of Artificial Sequence: Synthetic Antisense oligonucleotide
tcaaggaagatggca

SEQ ID NO: 967 - DNA, 14 bp, Artificial Sequence
  Description of Artificial Sequence: Synthetic Antisense oligonucleotide
tcaaggaagatggc

SEQ ID NO: 968 - DNA, 13 bp, Artificial Sequence
  Description of Artificial Sequence: Synthetic Antisense oligonucleotide
tcaaggaagatgg

SEQ ID NO: 969 - DNA, 12 bp, Artificial Sequence
  Description of Artificial Sequence: Synthetic Antisense oligonucleotide
tcaaggaagatg

SEQ ID NO: 970 - DNA, 11 bp, Artificial Sequence
  Description of Artificial Sequence: Synthetic Antisense oligonucleotide
tcaaggaagat

SEQ ID NO: 971 - DNA, 10 bp, Artificial Sequence
  Description of Artificial Sequence: Synthetic Antisense oligonucleotide
tcaaggaaga

SEQ ID NO: 972 - DNA, 9 bp, Artificial Sequence
  Description of Artificial Sequence: Synthetic Antisense oligonucleotide
tcaaggaag

SEQ ID NO: 973 - DNA, 21 bp, Artificial Sequence
  Description of Artificial Sequence: Synthetic Antisense oligonucleotide
caaggaagatggcatttctag

SEQ ID NO: 974 - DNA, 20 bp, Artificial Sequence
  Description of Artificial Sequence: Synthetic Antisense oligonucleotide
caaggaagatggcatttcta

SEQ ID NO: 975 - DNA, 19 bp, Artificial Sequence
  Description of Artificial Sequence: Synthetic Antisense oligonucleotide
caaggaagatggcatttct

SEQ ID NO: 976 - DNA, 18 bp, Artificial Sequence
  Description of Artificial Sequence: Synthetic Antisense oligonucleotide
caaggaagatggcatttc

SEQ ID NO: 977 - DNA, 17 bp, Artificial Sequence
  Description of Artificial Sequence: Synthetic Antisense oligonucleotide
caaggaagatggcattt

SEQ ID NO: 978 - DNA, 16 bp, Artificial Sequence
  Description of Artificial Sequence: Synthetic Antisense oligonucleotide
caaggaagatggcatt

SEQ ID NO: 979 - DNA, 15 bp, Artificial Sequence
  Description of Artificial Sequence: Synthetic Antisense oligonucleotide
caaggaagatggcat

SEQ ID NO: 980 - DNA, 14 bp, Artificial Sequence
  Description of Artificial Sequence: Synthetic Antisense oligonucleotide
caaggaagatggca

SEQ ID NO: 981 - DNA, 13 bp, Artificial Sequence
  Description of Artificial Sequence: Synthetic Antisense oligonucleotide
caaggaagatggc

SEQ ID NO: 982 - DNA, 12 bp, Artificial Sequence
  Description of Artificial Sequence: Synthetic Antisense oligonucleotide
caaggaagatgg

SEQ ID NO: 983 - DNA, 11 bp, Artificial Sequence
  Description of Artificial Sequence: Synthetic Antisense oligonucleotide
caaggaagatg

SEQ ID NO: 984 - DNA, 10 bp, Artificial Sequence
  Description of Artificial Sequence: Synthetic Antisense oligonucleotide
caaggaagat

SEQ ID NO: 985 - DNA, 20 bp, Artificial Sequence
  Description of Artificial Sequence: Synthetic Antisense oligonucleotide
aaggaagatggcatttctag

SEQ ID NO: 986 - DNA, 19 bp, Artificial Sequence
  Description of Artificial Sequence: Synthetic Antisense oligonucleotide
aaggaagatggcatttcta

SEQ ID NO: 987 - DNA, 18 bp, Artificial Sequence
  Description of Artificial Sequence: Synthetic Antisense oligonucleotide
aaggaagatggcatttct

SEQ ID NO: 988 - DNA, 17 bp, Artificial Sequence
  Description of Artificial Sequence: Synthetic Antisense oligonucleotide
aaggaagatggcatttc

SEQ ID NO: 989 - DNA, 16 bp, Artificial Sequence
  Description of Artificial Sequence: Synthetic Antisense oligonucleotide
aaggaagatggcattt

SEQ ID NO: 990 - DNA, 15 bp, Artificial Sequence
  Description of Artificial Sequence: Synthetic Antisense oligonucleotide
aaggaagatggcatt

SEQ ID NO: 991 - DNA, 14 bp, Artificial Sequence
  Description of Artificial Sequence: Synthetic Antisense oligonucleotide
aaggaagatggcat

SEQ ID NO: 992 - DNA, 13 bp, Artificial Sequence
  Description of Artificial Sequence: Synthetic Antisense oligonucleotide
aaggaagatggca

SEQ ID NO: 993 - DNA, 12 bp, Artificial Sequence
  Description of Artificial Sequence: Synthetic Antisense oligonucleotide
aaggaagatggc

SEQ ID NO: 994 - DNA, 11 bp, Artificial Sequence
  Description of Artificial Sequence: Synthetic Antisense oligonucleotide
aaggaagatgg

SEQ ID NO: 995 - DNA, 10 bp, Artificial Sequence
  Description of Artificial Sequence: Synthetic Antisense oligonucleotide
aaggaagatg

SEQ ID NO: 996 - DNA, 9 bp, Artificial Sequence
  Description of Artificial Sequence: Synthetic Antisense oligonucleotide
aaggaagat

SEQ ID NO: 997 - DNA, 19 bp, Artificial Sequence
  Description of Artificial Sequence: Synthetic Antisense oligonucleotide
aggaagatggcatttctag

SEQ ID NO: 998 - DNA, 18 bp, Artificial Sequence
  Description of Artificial Sequence: Synthetic Antisense oligonucleotide
aggaagatggcatttcta

SEQ ID NO: 999 - DNA, 17 bp, Artificial Sequence
  Description of Artificial Sequence: Synthetic Antisense oligonucleotide
aggaagatggcatttct

SEQ ID NO: 1000 - DNA, 16 bp, Artificial Sequence
  Description of Artificial Sequence: Synthetic Antisense oligonucleotide
aggaagatggcatttc

SEQ ID NO: 1001 - DNA, 15 bp, Artificial Sequence
  Description of Artificial Sequence: Synthetic Antisense oligonucleotide
aggaagatggcattt

SEQ ID NO: 1002 - DNA, 14 bp, Artificial Sequence
  Description of Artificial Sequence: Synthetic Antisense oligonucleotide
aggaagatggcatt

SEQ ID NO: 1003 - DNA, 13 bp, Artificial Sequence
  Description of Artificial Sequence: Synthetic Antisense oligonucleotide
aggaagatggcat

SEQ ID NO: 1004 - DNA, 12 bp, Artificial Sequence
  Description of Artificial Sequence: Synthetic Antisense oligonucleotide
aggaagatggca

SEQ ID NO: 1005 - DNA, 10 bp, Artificial Sequence
  Description of Artificial Sequence: Synthetic Antisense oligonucleotide
aggaagatgg

SEQ ID NO: 1006 - DNA, 9 bp, Artificial Sequence
  Description of Artificial Sequence: Synthetic Antisense oligonucleotide
aggaagatg

SEQ ID NO: 1007 - DNA, 8 bp, Artificial Sequence
  Description of Artificial Sequence: Synthetic Antisense oligonucleotide
aggaagat

SEQ ID NO: 1008 - DNA, 18 bp, Artificial Sequence
  Description of Artificial Sequence: Synthetic Antisense oligonucleotide
ggaagatggcatttctag

SEQ ID NO: 1009 - DNA, 17 bp, Artificial Sequence
  Description of Artificial Sequence: Synthetic Antisense oligonucleotide
ggaagatggcatttcta

SEQ ID NO: 1010 - DNA, 16 bp, Artificial Sequence
  Description of Artificial Sequence: Synthetic Antisense oligonucleotide
ggaagatggcatttct

SEQ ID NO: 1011 - DNA, 15 bp, Artificial Sequence
  Description of Artificial Sequence: Synthetic Antisense oligonucleotide
ggaagatggcatttc

SEQ ID NO: 1012 - DNA, 14 bp, Artificial Sequence
  Description of Artificial Sequence: Synthetic Antisense oligonucleotide
ggaagatggcattt

SEQ ID NO: 1013 - DNA, 13 bp, Artificial Sequence
  Description of Artificial Sequence: Synthetic Antisense oligonucleotide
ggaagatggcatt

SEQ ID NO: 1014 - DNA, 12 bp, Artificial Sequence
  Description of Artificial Sequence: Synthetic Antisense oligonucleotide
ggaagatggcat

SEQ ID NO: 1015 - DNA, 11 bp, Artificial Sequence
  Description of Artificial Sequence: Synthetic Antisense oligonucleotide
ggaagatggca

SEQ ID NO: 1016 - DNA, 10 bp, Artificial Sequence
  Description of Artificial Sequence: Synthetic Antisense oligonucleotide
ggaagatggc

SEQ ID NO: 1017 - DNA, 8 bp, Artificial Sequence
  Description of Artificial Sequence: Synthetic Antisense oligonucleotide
ggaagatg

SEQ ID NO: 1018 - DNA, 17 bp, Artificial Sequence
  Description of Artificial Sequence: Synthetic Antisense oligonucleotide
gaagatggcatttctag

SEQ ID NO: 1019 - DNA, 16 bp, Artificial Sequence
  Description of Artificial Sequence: Synthetic Antisense oligonucleotide
gaagatggcatttcta

SEQ ID NO: 1020 - DNA, 14 bp, Artificial Sequence
  Description of Artificial Sequence: Synthetic Antisense oligonucleotide
gaagatggcatttc

SEQ ID NO: 1021 - DNA, 13 bp, Artificial Sequence
  Description of Artificial Sequence: Synthetic Antisense oligonucleotide
gaagatggcattt

SEQ ID NO: 1022 - DNA, 12 bp, Artificial Sequence
  Description of Artificial Sequence: Synthetic Antisense oligonucleotide
gaagatggcatt

SEQ ID NO: 1023 - DNA, 11 bp, Artificial Sequence
  Description of Artificial Sequence: Synthetic Antisense oligonucleotide
gaagatggcat

SEQ ID NO: 1024 - DNA, 10 bp, Artificial Sequence
  Description of Artificial Sequence: Synthetic Antisense oligonucleotide
gaagatggca

SEQ ID NO: 1025 - DNA, 9 bp, Artificial Sequence
  Description of Artificial Sequence: Synthetic Antisense oligonucleotide
gaagatggc

SEQ ID NO: 1026 - DNA, 8 bp, Artificial Sequence
  Description of Artificial Sequence: Synthetic Antisense oligonucleotide
gaagatgg

SEQ ID NO: 1027 - DNA, 16 bp, Artificial Sequence
  Description of Artificial Sequence: Synthetic Antisense oligonucleotide
aagatggcatttctag

SEQ ID NO: 1028 - DNA, 15 bp, Artificial Sequence
  Description of Artificial Sequence: Synthetic Antisense oligonucleotide
aagatggcatttcta

SEQ ID NO: 1029 - DNA, 14 bp, Artificial Sequence
  Description of Artificial Sequence: Synthetic Antisense oligonucleotide
aagatggcatttct

SEQ ID NO: 1030 - DNA, 13 bp, Artificial Sequence
  Description of Artificial Sequence: Synthetic Antisense oligonucleotide
aagatggcatttc

SEQ ID NO: 1031 - DNA, 12 bp, Artificial Sequence
  Description of Artificial Sequence: Synthetic Antisense oligonucleotide
aagatggcattt

SEQ ID NO: 1032 - DNA, 11 bp, Artificial Sequence
  Description of Artificial Sequence: Synthetic Antisense oligonucleotide
aagatggcatt

SEQ ID NO: 1033 - DNA, 10 bp, Artificial Sequence
  Description of Artificial Sequence: Synthetic Antisense oligonucleotide
aagatggcat

SEQ ID NO: 1034 - DNA, 9 bp, Artificial Sequence
  Description of Artificial Sequence: Synthetic Antisense oligonucleotide
aagatggca

SEQ ID NO: 1035 - DNA, 8 bp, Artificial Sequence
  Description of Artificial Sequence: Synthetic Antisense oligonucleotide
aagatggc

SEQ ID NO: 1036 - DNA, 15 bp, Artificial Sequence
  Description of Artificial Sequence: Synthetic Antisense oligonucleotide
agatggcatttctag

SEQ ID NO: 1037 - DNA, 14 bp, Artificial Sequence
  Description of Artificial Sequence: Synthetic Antisense oligonucleotide
agatggcatttcta

SEQ ID NO: 1038 - DNA, 13 bp, Artificial Sequence
  Description of Artificial Sequence: Synthetic Antisense oligonucleotide
agatggcatttct

SEQ ID NO: 1039 - DNA, 12 bp, Artificial Sequence
  Description of Artificial Sequence: Synthetic Antisense oligonucleotide
agatggcatttc

SEQ ID NO: 1040 - DNA, 11 bp, Artificial Sequence
  Description of Artificial Sequence: Synthetic Antisense oligonucleotide
agatggcattt

SEQ ID NO: 1041 - DNA, 10 bp, Artificial Sequence
  Description of Artificial Sequence: Synthetic Antisense oligonucleotide
agatggcatt

SEQ ID NO: 1042 - DNA, 9 bp, Artificial Sequence
  Description of Artificial Sequence: Synthetic Antisense oligonucleotide
agatggcat

SEQ ID NO: 1043 - DNA, 8 bp, Artificial Sequence
  Description of Artificial Sequence: Synthetic Antisense oligonucleotide
agatggca

SEQ ID NO: 1044 - DNA, 30 bp, Artificial Sequence; identical to SEQ ID NO: 8
  Description of Artificial Sequence: Synthetic Antisense oligonucleotide

SEQ ID NO: 1045 - DNA, 29 bp, Artificial Sequence
  Description of Artificial Sequence: Synthetic Antisense oligonucleotide
ctccaacatcaaggaagatggcatttcta

SEQ ID NO: 1046 - DNA, 28 bp, Artificial Sequence
  Description of Artificial Sequence: Synthetic Antisense oligonucleotide
ctccaacatcaaggaagatggcatttct

SEQ ID NO: 1047 - DNA, 27 bp, Artificial Sequence
  Description of Artificial Sequence: Synthetic Antisense oligonucleotide
ctccaacatcaaggaagatggcatttc

SEQ ID NO: 1048 - DNA, 26 bp, Artificial Sequence
  Description of Artificial Sequence: Synthetic Antisense oligonucleotide
ctccaacatcaaggaagatggcattt

SEQ ID NO: 1049 - DNA, 25 bp, Artificial Sequence
  Description of Artificial Sequence: Synthetic Antisense oligonucleotide
ctccaacatcaaggaagatggcatt

SEQ ID NO: 1050 - DNA, 24 bp, Artificial Sequence
  Description of Artificial Sequence: Synthetic Antisense oligonucleotide
ctccaacatcaaggaagatggcat

SEQ ID NO: 1051 - DNA, 23 bp, Artificial Sequence
  Description of Artificial Sequence: Synthetic Antisense oligonucleotide
ctccaacatcaaggaagatggca

SEQ ID NO: 1052 - DNA, 22 bp, Artificial Sequence
  Description of Artificial Sequence: Synthetic Antisense oligonucleotide
ctccaacatcaaggaagatggc

SEQ ID NO: 1053 - DNA, 21 bp, Artificial Sequence
  Description of Artificial Sequence: Synthetic Antisense oligonucleotide
ctccaacatcaaggaagatgg

SEQ ID NO: 1054 - DNA, 20 bp, Artificial Sequence
  Description of Artificial Sequence: Synthetic Antisense oligonucleotide
ctccaacatcaaggaagatg

SEQ ID NO: 1055 - DNA, 19 bp, Artificial Sequence
  Description of Artificial Sequence: Synthetic Antisense oligonucleotide
ctccaacatcaaggaagat

SEQ ID NO: 1056 - DNA, 18 bp, Artificial Sequence
  Description of Artificial Sequence: Synthetic Antisense oligonucleotide
ctccaacatcaaggaaga

SEQ ID NO: 1057 - DNA, 17 bp, Artificial Sequence
  Description of Artificial Sequence: Synthetic Antisense oligonucleotide
ctccaacatcaaggaag

SEQ ID NO: 1058 - DNA, 29 bp, Artificial Sequence
  Description of Artificial Sequence: Synthetic Antisense oligonucleotide
tccaacatcaaggaagatggcatttctag

SEQ ID NO: 1059 - DNA, 28 bp, Artificial Sequence
  Description of Artificial Sequence: Synthetic Antisense oligonucleotide
tccaacatcaaggaagatggcatttcta

SEQ ID NO: 1060 - DNA, 27 bp, Artificial Sequence
  Description of Artificial Sequence: Synthetic Antisense oligonucleotide
tccaacatcaaggaagatggcatttct

SEQ ID NO: 1061 - DNA, 26 bp, Artificial Sequence
  Description of Artificial Sequence: Synthetic Antisense oligonucleotide
tccaacatcaaggaagatggcatttc

SEQ ID NO: 1062 - DNA, 25 bp, Artificial Sequence
  Description of Artificial Sequence: Synthetic Antisense oligonucleotide
tccaacatcaaggaagatggcattt

SEQ ID NO: 1063 - DNA, 24 bp, Artificial Sequence
  Description of Artificial Sequence: Synthetic Antisense oligonucleotide
tccaacatcaaggaagatggcatt

SEQ ID NO: 1064 - DNA, 23 bp, Artificial Sequence
  Description of Artificial Sequence: Synthetic Antisense oligonucleotide
tccaacatcaaggaagatggcat

SEQ ID NO: 1065 - DNA, 22 bp, Artificial Sequence
  Description of Artificial Sequence: Synthetic Antisense oligonucleotide
tccaacatcaaggaagatggca

SEQ ID NO: 1066 - DNA, 21 bp, Artificial Sequence
  Description of Artificial Sequence: Synthetic Antisense oligonucleotide
tccaacatcaaggaagatggc

SEQ ID NO: 1067 - DNA, 20 bp, Artificial Sequence
  Description of Artificial Sequence: Synthetic Antisense oligonucleotide
tccaacatcaaggaagatgg

SEQ ID NO: 1068 - DNA, 19 bp, Artificial Sequence
  Description of Artificial Sequence: Synthetic Antisense oligonucleotide
tccaacatcaaggaagatg

SEQ ID NO: 1069 - DNA, 18 bp, Artificial Sequence
  Description of Artificial Sequence: Synthetic Antisense oligonucleotide
tccaacatcaaggaagat

SEQ ID NO: 1070 - DNA, 17 bp, Artificial Sequence
  Description of Artificial Sequence: Synthetic Antisense oligonucleotide
tccaacatcaaggaaga

SEQ ID NO: 1071 - DNA, 16 bp, Artificial Sequence
  Description of Artificial Sequence: Synthetic Antisense oligonucleotide
tccaacatcaaggaag

SEQ ID NO: 1072 - DNA, 28 bp, Artificial Sequence
  Description of Artificial Sequence: Synthetic Antisense oligonucleotide
ccaacatcaaggaagatggcatttctag

SEQ ID NO: 1073 - DNA, 27 bp, Artificial Sequence
  Description of Artificial Sequence: Synthetic Antisense oligonucleotide
ccaacatcaaggaagatggcatttcta

SEQ ID NO: 1074 - DNA, 26 bp, Artificial Sequence
  Description of Artificial Sequence: Synthetic Antisense oligonucleotide
ccaacatcaaggaagatggcatttct

SEQ ID NO: 1075 - DNA, 25 bp, Artificial Sequence
  Description of Artificial Sequence: Synthetic Antisense oligonucleotide
ccaacatcaaggaagatggcatttc

SEQ ID NO: 1076 - DNA, 24 bp, Artificial Sequence
  Description of Artificial Sequence: Synthetic Antisense oligonucleotide
ccaacatcaaggaagatggcattt

SEQ ID NO: 1077 - DNA, 23 bp, Artificial Sequence
  Description of Artificial Sequence: Synthetic Antisense oligonucleotide
ccaacatcaaggaagatggcatt

SEQ ID NO: 1078 - DNA, 22 bp, Artificial Sequence
  Description of Artificial Sequence: Synthetic Antisense oligonucleotide
ccaacatcaaggaagatggcat

SEQ ID NO: 1079 - DNA, 21 bp, Artificial Sequence
  Description of Artificial Sequence: Synthetic Antisense oligonucleotide
ccaacatcaaggaagatggca

SEQ ID NO: 1080 - DNA, 20 bp, Artificial Sequence
  Description of Artificial Sequence: Synthetic Antisense oligonucleotide
ccaacatcaaggaagatggc

SEQ ID NO: 1081 - DNA, 19 bp, Artificial Sequence
  Description of Artificial Sequence: Synthetic Antisense oligonucleotide
ccaacatcaaggaagatgg

SEQ ID NO: 1082 - DNA, 18 bp, Artificial Sequence
  Description of Artificial Sequence: Synthetic Antisense oligonucleotide
ccaacatcaaggaagatg

SEQ ID NO: 1083 - DNA, 17 bp, Artificial Sequence
  Description of Artificial Sequence: Synthetic Antisense oligonucleotide
ccaacatcaaggaagat

SEQ ID NO: 1084 - DNA, 16 bp, Artificial Sequence
  Description of Artificial Sequence: Synthetic Antisense oligonucleotide
ccaacatcaaggaaga

SEQ ID NO: 1085 - DNA, 15 bp, Artificial Sequence
  Description of Artificial Sequence: Synthetic Antisense oligonucleotide
ccaacatcaaggaag

SEQ ID NO: 1086 - DNA, 27 bp, Artificial Sequence
  Description of Artificial Sequence: Synthetic Antisense oligonucleotide
caacatcaaggaagatggcatttctag

SEQ ID NO: 1087 - DNA, 26 bp, Artificial Sequence
  Description of Artificial Sequence: Synthetic Antisense oligonucleotide
caacatcaaggaagatggcatttcta

SEQ ID NO: 1088 - DNA, 25 bp, Artificial Sequence
  Description of Artificial Sequence: Synthetic Antisense oligonucleotide
caacatcaaggaagatggcatttct

SEQ ID NO: 1089 - DNA, 24 bp, Artificial Sequence
  Description of Artificial Sequence: Synthetic Antisense oligonucleotide
caacatcaaggaagatggcatttc

SEQ ID NO: 1090 - DNA, 23 bp, Artificial Sequence
  Description of Artificial Sequence: Synthetic Antisense oligonucleotide
caacatcaaggaagatggcattt

SEQ ID NO: 1091 - DNA, 22 bp, Artificial Sequence
  Description of Artificial Sequence: Synthetic Antisense oligonucleotide
caacatcaaggaagatggcatt

SEQ ID NO: 1092 - DNA, 21 bp, Artificial Sequence
  Description of Artificial Sequence: Synthetic Antisense oligonucleotide
caacatcaaggaagatggcat

SEQ ID NO: 1093 - DNA, 20 bp, Artificial Sequence
  Description of Artificial Sequence: Synthetic Antisense oligonucleotide
caacatcaaggaagatggca

SEQ ID NO: 1094 - DNA, 19 bp, Artificial Sequence
  Description of Artificial Sequence: Synthetic Antisense oligonucleotide
caacatcaaggaagatggc

SEQ ID NO: 1095 - DNA, 18 bp, Artificial Sequence
  Description of Artificial Sequence: Synthetic Antisense oligonucleotide
caacatcaaggaagatgg

SEQ ID NO: 1096 - DNA, 17 bp, Artificial Sequence
  Description of Artificial Sequence: Synthetic Antisense oligonucleotide
caacatcaaggaagatg

SEQ ID NO: 1097 - DNA, 16 bp, Artificial Sequence
  Description of Artificial Sequence: Synthetic Antisense oligonucleotide
caacatcaaggaagat

SEQ ID NO: 1098 - DNA, 15 bp, Artificial Sequence
  Description of Artificial Sequence: Synthetic Antisense oligonucleotide
caacatcaaggaaga

SEQ ID NO: 1099 - DNA, 14 bp, Artificial Sequence
  Description of Artificial Sequence: Synthetic Antisense oligonucleotide
caacatcaaggaag

SEQ ID NO: 1100 - DNA, 26 bp, Artificial Sequence
  Description of Artificial Sequence: Synthetic Antisense oligonucleotide
aacatcaaggaagatggcatttctag

SEQ ID NO: 1101 - DNA, 25 bp, Artificial Sequence
  Description of Artificial Sequence: Synthetic Antisense oligonucleotide
aacatcaaggaagatggcatttcta

SEQ ID NO: 1102 - DNA, 24 bp, Artificial Sequence
  Description of Artificial Sequence: Synthetic Antisense oligonucleotide
aacatcaaggaagatggcatttct

SEQ ID NO: 1103 - DNA, 23 bp, Artificial Sequence
  Description of Artificial Sequence: Synthetic Antisense oligonucleotide
aacatcaaggaagatggcatttc

SEQ ID NO: 1104 - DNA, 22 bp, Artificial Sequence
  Description of Artificial Sequence: Synthetic Antisense oligonucleotide
aacatcaaggaagatggcattt

SEQ ID NO: 1105 - DNA, 21 bp, Artificial Sequence
  Description of Artificial Sequence: Synthetic Antisense oligonucleotide
aacatcaaggaagatggcatt

SEQ ID NO: 1106 - DNA, 20 bp, Artificial Sequence
  Description of Artificial Sequence: Synthetic Antisense oligonucleotide
aacatcaaggaagatggcat

SEQ ID NO: 1107 - DNA, 19 bp, Artificial Sequence
  Description of Artificial Sequence: Synthetic Antisense oligonucleotide
aacatcaaggaagatggca

SEQ ID NO: 1108 - DNA, 18 bp, Artificial Sequence
  Description of Artificial Sequence: Synthetic Antisense oligonucleotide
aacatcaaggaagatggc

SEQ ID NO: 1109 - DNA, 17 bp, Artificial Sequence
  Description of Artificial Sequence: Synthetic Antisense oligonucleotide
aacatcaaggaagatgg

SEQ ID NO: 1110 - DNA, 16 bp, Artificial Sequence
  Description of Artificial Sequence: Synthetic Antisense oligonucleotide
aacatcaaggaagatg

SEQ ID NO: 1111 - DNA, 15 bp, Artificial Sequence
  Description of Artificial Sequence: Synthetic Antisense oligonucleotide
aacatcaaggaagat

SEQ ID NO: 1112 - DNA, 14 bp, Artificial Sequence
  Description of Artificial Sequence: Synthetic Antisense oligonucleotide
aacatcaaggaaga

SEQ ID NO: 1113 - DNA, 13 bp, Artificial Sequence
  Description of Artificial Sequence: Synthetic Antisense oligonucleotide
aacatcaaggaag

SEQ ID NO: 1114 - DNA, 25 bp, Artificial Sequence
  Description of Artificial Sequence: Synthetic Antisense oligonucleotide
acatcaaggaagatggcatttctag

SEQ ID NO: 1115 - DNA, 24 bp, Artificial Sequence
  Description of Artificial Sequence: Synthetic Antisense oligonucleotide
acatcaaggaagatggcatttcta

SEQ ID NO: 1116 - DNA, 23 bp, Artificial Sequence
  Description of Artificial Sequence: Synthetic Antisense oligonucleotide
acatcaaggaagatggcatttct

SEQ ID NO: 1117 - DNA, 22 bp, Artificial Sequence
  Description of Artificial Sequence: Synthetic Antisense oligonucleotide
acatcaaggaagatggcatttc

SEQ ID NO: 1118 - DNA, 21 bp, Artificial Sequence
  Description of Artificial Sequence: Synthetic Antisense oligonucleotide
acatcaaggaagatggcattt

SEQ ID NO: 1119 - DNA, 20 bp, Artificial Sequence
  Description of Artificial Sequence: Synthetic Antisense oligonucleotide
acatcaaggaagatggcatt

SEQ ID NO: 1120 - DNA, 19 bp, Artificial Sequence
  Description of Artificial Sequence: Synthetic Antisense oligonucleotide
acatcaaggaagatggcat

SEQ ID NO: 1121 - DNA, 18 bp, Artificial Sequence
  Description of Artificial Sequence: Synthetic Antisense oligonucleotide
acatcaaggaagatggca

SEQ ID NO: 1122 - DNA, 17 bp, Artificial Sequence
  Description of Artificial Sequence: Synthetic Antisense oligonucleotide
acatcaaggaagatggc

SEQ ID NO: 1123 - DNA, 16 bp, Artificial Sequence
  Description of Artificial Sequence: Synthetic Antisense oligonucleotide
acatcaaggaagatgg

SEQ ID NO: 1124 - DNA, 15 bp, Artificial Sequence
  Description of Artificial Sequence: Synthetic Antisense oligonucleotide
acatcaaggaagatg

SEQ ID NO: 1125 - DNA, 14 bp, Artificial Sequence
  Description of Artificial Sequence: Synthetic Antisense oligonucleotide
acatcaaggaagat

SEQ ID NO: 1126 - DNA, 13 bp, Artificial Sequence
  Description of Artificial Sequence: Synthetic Antisense oligonucleotide
acatcaaggaaga

SEQ ID NO: 1127 - DNA, 12 bp, Artificial Sequence
  Description of Artificial Sequence: Synthetic Antisense oligonucleotide
acatcaaggaag

SEQ ID NO: 1128 - DNA, 24 bp, Artificial Sequence
  Description of Artificial Sequence: Synthetic Antisense oligonucleotide
catcaaggaagatggcatttctag

SEQ ID NO: 1129 - DNA, 23 bp, Artificial Sequence
  Description of Artificial Sequence: Synthetic Antisense oligonucleotide
catcaaggaagatggcatttcta

SEQ ID NO: 1130 - DNA, 22 bp, Artificial Sequence
  Description of Artificial Sequence: Synthetic Antisense oligonucleotide
catcaaggaagatggcatttct

SEQ ID NO: 1131 - DNA, 21 bp, Artificial Sequence
  Description of Artificial Sequence: Synthetic Antisense oligonucleotide
catcaaggaagatggcatttc

SEQ ID NO: 1132 - DNA, 20 bp, Artificial Sequence
  Description of Artificial Sequence: Synthetic Antisense oligonucleotide
catcaaggaagatggcattt

SEQ ID NO: 1133 - DNA, 19 bp, Artificial Sequence
  Description of Artificial Sequence: Synthetic Antisense oligonucleotide
catcaaggaagatggcatt

SEQ ID NO: 1134 - DNA, 18 bp, Artificial Sequence
  Description of Artificial Sequence: Synthetic Antisense oligonucleotide
catcaaggaagatggcat

SEQ ID NO: 1135 - DNA, 17 bp, Artificial Sequence
  Description of Artificial Sequence: Synthetic Antisense oligonucleotide
catcaaggaagatggca

SEQ ID NO: 1136 - DNA, 16 bp, Artificial Sequence
  Description of Artificial Sequence: Synthetic Antisense oligonucleotide
catcaaggaagatggc

SEQ ID NO: 1137 - DNA, 15 bp, Artificial Sequence
  Description of Artificial Sequence: Synthetic Antisense oligonucleotide
catcaaggaagatgg

SEQ ID NO: 1138 - DNA, 14 bp, Artificial Sequence
  Description of Artificial Sequence: Synthetic Antisense oligonucleotide
catcaaggaagatg

SEQ ID NO: 1139 - DNA, 13 bp, Artificial Sequence
  Description of Artificial Sequence: Synthetic Antisense oligonucleotide
catcaaggaagat

SEQ ID NO: 1140 - DNA, 12 bp, Artificial Sequence
  Description of Artificial Sequence: Synthetic Antisense oligonucleotide
catcaaggaaga

SEQ ID NO: 1141 - DNA, 11 bp, Artificial Sequence
  Description of Artificial Sequence: Synthetic Antisense oligonucleotide
catcaaggaag

SEQ ID NO: 1142 - DNA, 23 bp, Artificial Sequence
  Description of Artificial Sequence: Synthetic Antisense oligonucleotide
atcaaggaagatggcatttctag

SEQ ID NO: 1143 - DNA, 22 bp, Artificial Sequence
  Description of Artificial Sequence: Synthetic Antisense oligonucleotide
atcaaggaagatggcatttcta

SEQ ID NO: 1144 - DNA, 21 bp, Artificial Sequence
  Description of Artificial Sequence: Synthetic Antisense oligonucleotide
atcaaggaagatggcatttct

SEQ ID NO: 1145 - DNA, 20 bp, Artificial Sequence
  Description of Artificial Sequence: Synthetic Antisense oligonucleotide
atcaaggaagatggcatttc

SEQ ID NO: 1146 - DNA, 19 bp, Artificial Sequence
  Description of Artificial Sequence: Synthetic Antisense oligonucleotide
atcaaggaagatggcattt

SEQ ID NO: 1147 - DNA, 18 bp, Artificial Sequence
  Description of Artificial Sequence: Synthetic Antisense oligonucleotide
atcaaggaagatggcatt

SEQ ID NO: 1148 - DNA, 17 bp, Artificial Sequence
  Description of Artificial Sequence: Synthetic Antisense oligonucleotide
atcaaggaagatggcat

SEQ ID NO: 1149 - DNA, 16 bp, Artificial Sequence
  Description of Artificial Sequence: Synthetic Antisense oligonucleotide
atcaaggaagatggca

SEQ ID NO: 1150 - DNA, 15 bp, Artificial Sequence
  Description of Artificial Sequence: Synthetic Antisense oligonucleotide
atcaaggaagatggc

SEQ ID NO: 1151 - DNA, 14 bp, Artificial Sequence
  Description of Artificial Sequence: Synthetic Antisense oligonucleotide
atcaaggaagatgg

SEQ ID NO: 1152 - DNA, 13 bp, Artificial Sequence
  Description of Artificial Sequence: Synthetic Antisense oligonucleotide
atcaaggaagatg

SEQ ID NO: 1153 - DNA, 12 bp, Artificial Sequence
  Description of Artificial Sequence: Synthetic Antisense oligonucleotide
atcaaggaagat

SEQ ID NO: 1154 - DNA, 11 bp, Artificial Sequence
  Description of Artificial Sequence: Synthetic Antisense oligonucleotide
atcaaggaaga

SEQ ID NO: 1155 - DNA, 10 bp, Artificial Sequence
  Description of Artificial Sequence: Synthetic Antisense oligonucleotide
atcaaggaag

SEQ ID NO: 1156 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
ggtaagttctgtccaagc

SEQ ID NO: 1157 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
gtaagttctgtccaagcc

SEQ ID NO: 1158 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agtcggtaagttctgtcc

SEQ ID NO: 1159 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
ctgtccaagcccggttga

SEQ ID NO: 1160 - DNA, 15 bp, Artificial Sequence
  Description of Artificial Sequence: Synthetic Antisense oligonucleotide
  misc_feature (7)..(7): 5-methyl
  misc_feature (11)..(12): 5-methyl
taagttctgtccaag

SEQ ID NO: 1161 - DNA, 20 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
ttctgtccaagcccggttga

SEQ ID NO: 1162 - DNA, 19 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
ttctgtccaagcccggttg

SEQ ID NO: 1163 - DNA, 18 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
ttctgtccaagcccggtt

SEQ ID NO: 1164 - DNA, 17 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
ttctgtccaagcccggt

SEQ ID NO: 1165 - DNA, 16 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
ttctgtccaagcccgg

SEQ ID NO: 1166 - DNA, 15 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
ttctgtccaagcccg

SEQ ID NO: 1167 - DNA, 14 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
ttctgtccaagccc

SEQ ID NO: 1168 - DNA, 13 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(13): 5-methyl
ttctgtccaagcc

SEQ ID NO: 1169 - DNA, 12 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(12): 5-methyl
ttctgtccaagc

SEQ ID NO: 1170 - DNA, 11 bp, Artificial Sequence
  Description of Artificial Sequence: Synthetic Antisense oligonucleotide
  misc_feature (3)..(3): 5-methyl
  misc_feature (7)..(8): 5-methyl
ttctgtccaag

SEQ ID NO: 1171 - DNA, 10 bp, Artificial Sequence
  Description of Artificial Sequence: Synthetic Antisense oligonucleotide
  misc_feature (3)..(3): 5-methyl
  misc_feature (7)..(8): 5-methyl
ttctgtccaa

SEQ ID NO: 1172 - DNA, 9 bp, Artificial Sequence
  Description of Artificial Sequence: Synthetic Antisense oligonucleotide
  misc_feature (3)..(3): 5-methyl
  misc_feature (7)..(8): 5-methyl
ttctgtcca

SEQ ID NO: 1173 - DNA, 8 bp, Artificial Sequence
  Description of Artificial Sequence: Synthetic Antisense oligonucleotide
  misc_feature (3)..(3): 5-methyl
  misc_feature (7)..(8): 5-methyl
ttctgtcc

SEQ ID NO: 1174 - DNA, 19 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
tctgtccaagcccggttga

SEQ ID NO: 1175 - DNA, 18 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
tctgtccaagcccggttg

SEQ ID NO: 1176 - DNA, 17 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
tctgtccaagcccggtt

SEQ ID NO: 1177 - DNA, 16 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
tctgtccaagcccggt

SEQ ID NO: 1178 - DNA, 15 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
tctgtccaagcccgg

SEQ ID NO: 1179 - DNA, 14 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
tctgtccaagcccg

SEQ ID NO: 1180 - DNA, 13 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
tctgtccaagccc

SEQ ID NO: 1181 - DNA, 12 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(12): 5-methyl
tctgtccaagcc

SEQ ID NO: 1182 - DNA, 11 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(11): 5-methyl
tctgtccaagc

SEQ ID NO: 1183 - DNA, 10 bp, Artificial Sequence
  Description of Artificial Sequence: Synthetic Antisense oligonucleotide
  misc_feature (2)..(2): 5-methyl
  misc_feature (6)..(7): 5-methyl
tctgtccaag

SEQ ID NO: 1184 - DNA, 9 bp, Artificial Sequence
  Description of Artificial Sequence: Synthetic Antisense oligonucleotide
  misc_feature (2)..(2): 5-methyl
  misc_feature (6)..(7): 5-methyl
tctgtccaa

SEQ ID NO: 1185 - DNA, 8 bp, Artificial Sequence
  Description of Artificial Sequence: Synthetic Antisense oligonucleotide
  misc_feature (2)..(2): 5-methyl
  misc_feature (6)..(7): 5-methyl
tctgtcca

SEQ ID NO: 1186 - DNA, 17 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
ctgtccaagcccggttg

SEQ ID NO: 1187 - DNA, 16 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
ctgtccaagcccggtt

SEQ ID NO: 1188 - DNA, 15 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
ctgtccaagcccggt

SEQ ID NO: 1189 - DNA, 14 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
ctgtccaagcccgg

SEQ ID NO: 1190 - DNA, 13 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
ctgtccaagcccg

SEQ ID NO: 1191 - DNA, 12 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
ctgtccaagccc

SEQ ID NO: 1192 - DNA, 11 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(11): 5-methyl
ctgtccaagcc

SEQ ID NO: 1193 - DNA, 10 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(10): 5-methyl
ctgtccaagc

SEQ ID NO: 1194 - DNA, 9 bp, Artificial Sequence
  Description of Artificial Sequence: Synthetic Antisense oligonucleotide
  misc_feature (1)..(1): 5-methyl
  misc_feature (5)..(6): 5-methyl
ctgtccaag

SEQ ID NO: 1195 - DNA, 8 bp, Artificial Sequence
  Description of Artificial Sequence: Synthetic Antisense oligonucleotide
  misc_feature (1)..(1): 5-methyl
  misc_feature (5)..(6): 5-methyl
ctgtccaa

SEQ ID NO: 1196 - DNA, 20 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
gttctgtccaagcccggttg

SEQ ID NO: 1197 - DNA, 19 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
gttctgtccaagcccggtt

SEQ ID NO: 1198 - DNA, 18 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
gttctgtccaagcccggt

SEQ ID NO: 1199 - DNA, 17 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
gttctgtccaagcccgg

SEQ ID NO: 1200 - DNA, 16 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
gttctgtccaagcccg

SEQ ID NO: 1201 - DNA, 15 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
gttctgtccaagccc

SEQ ID NO: 1202 - DNA, 14 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(14): 5-methyl
gttctgtccaagcc

SEQ ID NO: 1203 - DNA, 13 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(13): 5-methyl
gttctgtccaagc

SEQ ID NO: 1204 - DNA, 12 bp, Artificial Sequence
  Description of Artificial Sequence: Synthetic Antisense oligonucleotide
  misc_feature (4)..(4): 5-methyl
  misc_feature (8)..(9): 5-methyl
gttctgtccaag

SEQ ID NO: 1205 - DNA, 11 bp, Artificial Sequence
  Description of Artificial Sequence: Synthetic Antisense oligonucleotide
  misc_feature (4)..(4): 5-methyl
  misc_feature (8)..(9): 5-methyl
gttctgtccaa

SEQ ID NO: 1206 - DNA, 10 bp, Artificial Sequence
  Description of Artificial Sequence: Synthetic Antisense oligonucleotide
  misc_feature (4)..(4): 5-methyl
  misc_feature (8)..(9): 5-methyl
gttctgtcca

SEQ ID NO: 1207 - DNA, 9 bp, Artificial Sequence
  Description of Artificial Sequence: Synthetic Antisense oligonucleotide
  misc_feature (4)..(4): 5-methyl
  misc_feature (8)..(9): 5-methyl
gttctgtcc

SEQ ID NO: 1208 - DNA, 8 bp, Artificial Sequence
  Description of Artificial Sequence: Synthetic Antisense oligonucleotide
  misc_feature (4)..(4): 5-methyl
  misc_feature (8)..(8): 5-methyl
gttctgtc

SEQ ID NO: 1209 - DNA, 20 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
agttctgtccaagcccggtt

SEQ ID NO: 1210 - DNA, 19 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
agttctgtccaagcccggt

SEQ ID NO: 1211 - DNA, 18 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
agttctgtccaagcccgg

SEQ ID NO: 1212 - DNA, 17 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
agttctgtccaagcccg

SEQ ID NO: 1213 - DNA, 16 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
agttctgtccaagccc

SEQ ID NO: 1214 - DNA, 15 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(15): 5-methyl
agttctgtccaagcc

SEQ ID NO: 1215 - DNA, 14 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(14): 5-methyl
agttctgtccaagc

SEQ ID NO: 1216 - DNA, 13 bp, Artificial Sequence
  Description of Artificial Sequence: Synthetic Antisense oligonucleotide
  misc_feature (5)..(5): 5-methyl
  misc_feature (9)..(10): 5-methyl
agttctgtccaag

SEQ ID NO: 1217 - DNA, 12 bp, Artificial Sequence
  Description of Artificial Sequence: Synthetic Antisense oligonucleotide
  misc_feature (5)..(5): 5-methyl
  misc_feature (9)..(10): 5-methyl
agttctgtccaa

SEQ ID NO: 1218 - DNA, 11 bp, Artificial Sequence
  Description of Artificial Sequence: Synthetic Antisense oligonucleotide
  misc_feature (5)..(5): 5-methyl
  misc_feature (9)..(10): 5-methyl
agttctgtcca

SEQ ID NO: 1219 - DNA, 10 bp, Artificial Sequence
  Description of Artificial Sequence: Synthetic Antisense oligonucleotide
  misc_feature (5)..(5): 5-methyl
  misc_feature (9)..(10): 5-methyl
agttctgtcc

SEQ ID NO: 1220 - DNA, 9 bp, Artificial Sequence
  Description of Artificial Sequence: Synthetic Antisense oligonucleotide
  misc_feature (5)..(5): 5-methyl
  misc_feature (9)..(9): 5-methyl
agttctgtc

SEQ ID NO: 1221 - DNA, 8 bp, Artificial Sequence
  Description of Artificial Sequence: Synthetic Antisense oligonucleotide
  misc_feature (5)..(5): 5-methyl
agttctgt

SEQ ID NO: 1222 - DNA, 20 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
aagttctgtccaagcccggt

SEQ ID NO: 1223 - DNA, 19 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
aagttctgtccaagcccgg

SEQ ID NO: 1224 - DNA, 18 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
aagttctgtccaagcccg

SEQ ID NO: 1225 - DNA, 17 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
aagttctgtccaagccc

SEQ ID NO: 1226 - DNA, 16 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(16): 5-methyl
aagttctgtccaagcc

SEQ ID NO: 1227 - DNA, 15 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(15): 5-methyl
aagttctgtccaagc

SEQ ID NO: 1228 - DNA, 14 bp, Artificial Sequence
  Description of Artificial Sequence: Synthetic Antisense oligonucleotide
  misc_feature (6)..(6): 5-methyl
  misc_feature (10)..(11): 5-methyl
aagttctgtccaag

SEQ ID NO: 1229 - DNA, 13 bp, Artificial Sequence
  Description of Artificial Sequence: Synthetic Antisense oligonucleotide
  misc_feature (6)..(6): 5-methyl
  misc_feature (10)..(11): 5-methyl
aagttctgtccaa

SEQ ID NO: 1230 - DNA, 12 bp, Artificial Sequence
  Description of Artificial Sequence: Synthetic Antisense oligonucleotide
  misc_feature (6)..(6): 5-methyl
  misc_feature (10)..(11): 5-methyl
aagttctgtcca

SEQ ID NO: 1231 - DNA, 11 bp, Artificial Sequence
  Description of Artificial Sequence: Synthetic Antisense oligonucleotide
  misc_feature (6)..(6): 5-methyl
  misc_feature (10)..(11): 5-methyl
aagttctgtcc

SEQ ID NO: 1232 - DNA, 10 bp, Artificial Sequence
  Description of Artificial Sequence: Synthetic Antisense oligonucleotide
  misc_feature (6)..(6): 5-methyl
  misc_feature (10)..(10): 5-methyl
aagttctgtc

SEQ ID NO: 1233 - DNA, 9 bp, Artificial Sequence
  Description of Artificial Sequence: Synthetic Antisense oligonucleotide
  misc_feature (6)..(6): 5-methyl
aagttctgt

SEQ ID NO: 1234 - DNA, 8 bp, Artificial Sequence
  Description of Artificial Sequence: Synthetic Antisense oligonucleotide
  misc_feature (6)..(6): 5-methyl
aagttctg

SEQ ID NO: 1235 - DNA, 20 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
taagttctgtccaagcccgg

SEQ ID NO: 1236 - DNA, 19 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
taagttctgtccaagcccg

SEQ ID NO: 1237 - DNA, 18 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
taagttctgtccaagccc

SEQ ID NO: 1238 - DNA, 17 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(17): 5-methyl
taagttctgtccaagcc

SEQ ID NO: 1239 - DNA, 16 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(16): 5-methyl
taagttctgtccaagc

SEQ ID NO: 1240 - DNA, 14 bp, Artificial Sequence
  Description of Artificial Sequence: Synthetic Antisense oligonucleotide
  misc_feature (7)..(7): 5-methyl
  misc_feature (11)..(12): 5-methyl
taagttctgtccaa

SEQ ID NO: 1241 - DNA, 13 bp, Artificial Sequence
  Description of Artificial Sequence: Synthetic Antisense oligonucleotide
  misc_feature (7)..(7): 5-methyl
  misc_feature (11)..(12): 5-methyl
taagttctgtcca

SEQ ID NO: 1242 - DNA, 12 bp, Artificial Sequence
  Description of Artificial Sequence: Synthetic Antisense oligonucleotide
  misc_feature (7)..(7): 5-methyl
  misc_feature (11)..(12): 5-methyl
taagttctgtcc

SEQ ID NO: 1243 - DNA, 11 bp, Artificial Sequence
  Description of Artificial Sequence: Synthetic Antisense oligonucleotide
  misc_feature (7)..(7): 5-methyl
  misc_feature (11)..(11): 5-methyl
taagttctgtc

SEQ ID NO: 1244 - DNA, 10 bp, Artificial Sequence
  Description of Artificial Sequence: Synthetic Antisense oligonucleotide
  misc_feature (7)..(7): 5-methyl
taagttctgt

SEQ ID NO: 1245 - DNA, 9 bp, Artificial Sequence
  Description of Artificial Sequence: Synthetic Antisense oligonucleotide
  misc_feature (7)..(7): 5-methyl
taagttctg

SEQ ID NO: 1246 - DNA, 8 bp, Artificial Sequence
  Description of Artificial Sequence: Synthetic Antisense oligonucleotide
  misc_feature (7)..(7): 5-methyl
taagttct

SEQ ID NO: 1247 - DNA, 20 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(19): 5-methyl
gtaagttctgtccaagcccg

SEQ ID NO: 1248 - DNA, 19 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(19): 5-methyl
gtaagttctgtccaagccc

SEQ ID NO: 1249 - DNA, 17 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(17): 5-methyl
gtaagttctgtccaagc

SEQ ID NO: 1250 - DNA, 16 bp, Artificial Sequence
  Description of Artificial Sequence: Synthetic Antisense oligonucleotide
  misc_feature (8)..(8): 5-methyl
  misc_feature (12)..(13): 5-methyl
gtaagttctgtccaag

SEQ ID NO: 1251 - DNA, 15 bp, Artificial Sequence
  Description of Artificial Sequence: Synthetic Antisense oligonucleotide
  misc_feature (8)..(8): 5-methyl
  misc_feature (12)..(13): 5-methyl
gtaagttctgtccaa

SEQ ID NO: 1252 - DNA, 14 bp, Artificial Sequence
  Description of Artificial Sequence: Synthetic Antisense oligonucleotide
  misc_feature (8)..(8): 5-methyl
  misc_feature (12)..(13): 5-methyl
gtaagttctgtcca

SEQ ID NO: 1253 - DNA, 13 bp, Artificial Sequence
  Description of Artificial Sequence: Synthetic Antisense oligonucleotide
  misc_feature (8)..(8): 5-methyl
  misc_feature (12)..(13): 5-methyl
gtaagttctgtcc

SEQ ID NO: 1254 - DNA, 12 bp, Artificial Sequence
  Description of Artificial Sequence: Synthetic Antisense oligonucleotide
  misc_feature (8)..(8): 5-methyl
  misc_feature (12)..(12): 5-methyl
gtaagttctgtc

SEQ ID NO: 1255 - DNA, 11 bp, Artificial Sequence
  Description of Artificial Sequence: Synthetic Antisense oligonucleotide
  misc_feature (8)..(8): 5-methyl
gtaagttctgt

SEQ ID NO: 1256 - DNA, 10 bp, Artificial Sequence
  Description of Artificial Sequence: Synthetic Antisense oligonucleotide
  misc_feature (8)..(8): 5-methyl
gtaagttctg

SEQ ID NO: 1257 - DNA, 9 bp, Artificial Sequence
  Description of Artificial Sequence: Synthetic Antisense oligonucleotide
  misc_feature (8)..(8): 5-methyl
gtaagttct

SEQ ID NO: 1258 - DNA, 8 bp, Artificial Sequence
  Description of Artificial Sequence: Synthetic Antisense oligonucleotide
  misc_feature (8)..(8): 5-methyl
gtaagttc

SEQ ID NO: 1259 - DNA, 20 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(20): 5-methyl
ggtaagttctgtccaagccc

SEQ ID NO: 1260 - DNA, 19 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(19): 5-methyl
ggtaagttctgtccaagcc

SEQ ID NO: 1261 - DNA, 17 bp, Artificial Sequence
  Description of Artificial Sequence: Synthetic Antisense oligonucleotide
  misc_feature (9)..(9): 5-methyl
  misc_feature (13)..(14): 5-methyl
ggtaagttctgtccaag

SEQ ID NO: 1262 - DNA, 16 bp, Artificial Sequence
  Description of Artificial Sequence: Synthetic Antisense oligonucleotide
  misc_feature (9)..(9): 5-methyl
  misc_feature (13)..(14): 5-methyl
ggtaagttctgtccaa

SEQ ID NO: 1263 - DNA, 15 bp, Artificial Sequence
  Description of Artificial Sequence: Synthetic Antisense oligonucleotide
  misc_feature (9)..(9): 5-methyl
  misc_feature (13)..(14): 5-methyl
ggtaagttctgtcca

SEQ ID NO: 1264 - DNA, 14 bp, Artificial Sequence
  Description of Artificial Sequence: Synthetic Antisense oligonucleotide
  misc_feature (9)..(9): 5-methyl
  misc_feature (13)..(14): 5-methyl
ggtaagttctgtcc

SEQ ID NO: 1265 - DNA, 13 bp, Artificial Sequence
  Description of Artificial Sequence: Synthetic Antisense oligonucleotide
  misc_feature (9)..(9): 5-methyl
  misc_feature (13)..(13): 5-methyl
ggtaagttctgtc

SEQ ID NO: 1266 - DNA, 12 bp, Artificial Sequence
  Description of Artificial Sequence: Synthetic Antisense oligonucleotide
  misc_feature (9)..(9): 5-methyl
ggtaagttctgt

SEQ ID NO: 1267 - DNA, 11 bp, Artificial Sequence
  Description of Artificial Sequence: Synthetic Antisense oligonucleotide
  misc_feature (9)..(9): 5-methyl
ggtaagttctg

SEQ ID NO: 1268 - DNA, 10 bp, Artificial Sequence
  Description of Artificial Sequence: Synthetic Antisense oligonucleotide
  misc_feature (9)..(9): 5-methyl
ggtaagttct

SEQ ID NO: 1269 - DNA, 9 bp, Artificial Sequence
  Description of Artificial Sequence: Synthetic Antisense oligonucleotide
  misc_feature (9)..(9): 5-methyl
ggtaagttc

SEQ ID NO: 1270 - DNA, 20 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(20): 5-methyl
cggtaagttctgtccaagcc

SEQ ID NO: 1271 - DNA, 19 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(19): 5-methyl
cggtaagttctgtccaagc

SEQ ID NO: 1272 - DNA, 18 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
cggtaagttctgtccaag

SEQ ID NO: 1273 - DNA, 17 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
cggtaagttctgtccaa

SEQ ID NO: 1274 - DNA, 16 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
cggtaagttctgtcca

SEQ ID NO: 1275 - DNA, 15 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
cggtaagttctgtcc

SEQ ID NO: 1276 - DNA, 14 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(14): 5-methyl
cggtaagttctgtc

SEQ ID NO: 1277 - DNA, 13 bp, Artificial Sequence
  Description of Artificial Sequence: Synthetic Antisense oligonucleotide
  misc_feature (1)..(1): 5-methyl
  misc_feature (10)..(10): 5-methyl
cggtaagttctgt

SEQ ID NO: 1278 - DNA, 12 bp, Artificial Sequence
  Description of Artificial Sequence: Synthetic Antisense oligonucleotide
  misc_feature (1)..(1): 5-methyl
  misc_feature (10)..(10): 5-methyl
cggtaagttctg

SEQ ID NO: 1279 - DNA, 11 bp, Artificial Sequence
  Description of Artificial Sequence: Synthetic Antisense oligonucleotide
  misc_feature (1)..(1): 5-methyl
  misc_feature (10)..(10): 5-methyl
cggtaagttct

SEQ ID NO: 1280 - DNA, 10 bp, Artificial Sequence
  Description of Artificial Sequence: Synthetic Antisense oligonucleotide
  misc_feature (1)..(1): 5-methyl
  misc_feature (10)..(10): 5-methyl
cggtaagttc

SEQ ID NO: 1281 - DNA, 9 bp, Artificial Sequence
  Description of Artificial Sequence: Synthetic Antisense oligonucleotide
  misc_feature (1)..(1): 5-methyl
cggtaagtt

SEQ ID NO: 1282 - DNA, 8 bp, Artificial Sequence
  Description of Artificial Sequence: Synthetic Antisense oligonucleotide
  misc_feature (1)..(1): 5-methyl
cggtaagt

SEQ ID NO: 1283 - DNA, 20 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (20)..(20): 5-methyl
tcggtaagttctgtccaagc

SEQ ID NO: 1284 - DNA, 19 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
tcggtaagttctgtccaag

SEQ ID NO: 1285 - DNA, 18 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
tcggtaagttctgtccaa

SEQ ID NO: 1286 - DNA, 17 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
tcggtaagttctgtcca

SEQ ID NO: 1287 - DNA, 16 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
tcggtaagttctgtcc

SEQ ID NO: 1288 - DNA, 15 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(15): 5-methyl
tcggtaagttctgtc

SEQ ID NO: 1289 - DNA, 14 bp, Artificial Sequence
  Description of Artificial Sequence: Synthetic Antisense oligonucleotide
  misc_feature (2)..(2): 5-methyl
  misc_feature (11)..(11): 5-methyl
tcggtaagttctgt

SEQ ID NO: 1290 - DNA, 13 bp, Artificial Sequence
  Description of Artificial Sequence: Synthetic Antisense oligonucleotide
  misc_feature (2)..(2): 5-methyl
  misc_feature (11)..(11): 5-methyl
tcggtaagttctg

SEQ ID NO: 1291 - DNA, 12 bp, Artificial Sequence
  Description of Artificial Sequence: Synthetic Antisense oligonucleotide
  misc_feature (2)..(2): 5-methyl
  misc_feature (11)..(11): 5-methyl
tcggtaagttct

SEQ ID NO: 1292 - DNA, 11 bp, Artificial Sequence
  Description of Artificial Sequence: Synthetic Antisense oligonucleotide
  misc_feature (2)..(2): 5-methyl
  misc_feature (11)..(11): 5-methyl
tcggtaagttc

SEQ ID NO: 1293 - DNA, 10 bp, Artificial Sequence
  Description of Artificial Sequence: Synthetic Antisense oligonucleotide
  misc_feature (2)..(2): 5-methyl
tcggtaagtt

SEQ ID NO: 1294 - DNA, 9 bp, Artificial Sequence
  Description of Artificial Sequence: Synthetic Antisense oligonucleotide
  misc_feature (2)..(2): 5-methyl
tcggtaagt

SEQ ID NO: 1295 - DNA, 20 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
gtcggtaagttctgtccaag

SEQ ID NO: 1296 - DNA, 19 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
gtcggtaagttctgtccaa

SEQ ID NO: 1297 - DNA, 18 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
gtcggtaagttctgtcca

SEQ ID NO: 1298 - DNA, 17 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
gtcggtaagttctgtcc

SEQ ID NO: 1299 - DNA, 16 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(16): 5-methyl
gtcggtaagttctgtc

SEQ ID NO: 1300 - DNA, 15 bp, Artificial Sequence
  Description of Artificial Sequence: Synthetic Antisense oligonucleotide
  misc_feature (3)..(3): 5-methyl
  misc_feature (12)..(12): 5-methyl
gtcggtaagttctgt

SEQ ID NO: 1301 - DNA, 14 bp, Artificial Sequence
  Description of Artificial Sequence: Synthetic Antisense oligonucleotide
  misc_feature (3)..(3): 5-methyl
  misc_feature (12)..(12): 5-methyl
gtcggtaagttctg

SEQ ID NO: 1302 - DNA, 13 bp, Artificial Sequence
  Description of Artificial Sequence: Synthetic Antisense oligonucleotide
  misc_feature (3)..(3): 5-methyl
  misc_feature (12)..(12): 5-methyl
gtcggtaagttct

SEQ ID NO: 1303 - DNA, 12 bp, Artificial Sequence
  Description of Artificial Sequence: Synthetic Antisense oligonucleotide
  misc_feature (3)..(3): 5-methyl
  misc_feature (12)..(12): 5-methyl
gtcggtaagttc

SEQ ID NO: 1304 - DNA, 11 bp, Artificial Sequence
  Description of Artificial Sequence: Synthetic Antisense oligonucleotide
  misc_feature (3)..(3): 5-methyl
gtcggtaagtt

SEQ ID NO: 1305 - DNA, 10 bp, Artificial Sequence
  Description of Artificial Sequence: Synthetic Antisense oligonucleotide
  misc_feature (3)..(3): 5-methyl
gtcggtaagt

SEQ ID NO: 1306 - DNA, 20 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agtcggtaagttctgtccaa

SEQ ID NO: 1307 - DNA, 19 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agtcggtaagttctgtcca

SEQ ID NO: 1308 - DNA, 17 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(17): 5-methyl
agtcggtaagttctgtc

SEQ ID NO: 1309 - DNA, 16 bp, Artificial Sequence
  Description of Artificial Sequence: Synthetic Antisense oligonucleotide
  misc_feature (4)..(4): 5-methyl
  misc_feature (13)..(13): 5-methyl
agtcggtaagttctgt

SEQ ID NO: 1310 - DNA, 15 bp, Artificial Sequence
  Description of Artificial Sequence: Synthetic Antisense oligonucleotide
  misc_feature (4)..(4): 5-methyl
  misc_feature (13)..(13): 5-methyl
agtcggtaagttctg

SEQ ID NO: 1311 - DNA, 14 bp, Artificial Sequence
  Description of Artificial Sequence: Synthetic Antisense oligonucleotide
  misc_feature (4)..(4): 5-methyl
  misc_feature (13)..(13): 5-methyl
agtcggtaagttct

SEQ ID NO: 1312 - DNA, 13 bp, Artificial Sequence
  Description of Artificial Sequence: Synthetic Antisense oligonucleotide
  misc_feature (4)..(4): 5-methyl
  misc_feature (13)..(13): 5-methyl
agtcggtaagttc

SEQ ID NO: 1313 - DNA, 12 bp, Artificial Sequence
  Description of Artificial Sequence: Synthetic Antisense oligonucleotide
  misc_feature (4)..(4): 5-methyl
agtcggtaagtt

SEQ ID NO: 1314 - DNA, 11 bp, Artificial Sequence
  Description of Artificial Sequence: Synthetic Antisense oligonucleotide
  misc_feature (4)..(4): 5-methyl
agtcggtaagt

SEQ ID NO: 1315 - DNA, 20 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
cagtcggtaagttctgtcca

SEQ ID NO: 1316 - DNA, 19 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
cagtcggtaagttctgtcc

SEQ ID NO: 1317 - DNA, 18 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(18): 5-methyl
cagtcggtaagttctgtc

SEQ ID NO: 1318 - DNA, 17 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
cagtcggtaagttctgt

SEQ ID NO: 1319 - DNA, 16 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
cagtcggtaagttctg

SEQ ID NO: 1320 - DNA, 15 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
cagtcggtaagttct

SEQ ID NO: 1321 - DNA, 14 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
cagtcggtaagttc

SEQ ID NO: 1322 - DNA, 13 bp, Artificial Sequence
  Description of Artificial Sequence: Synthetic Antisense oligonucleotide
  misc_feature (1)..(1): 5-methyl
  misc_feature (5)..(5): 5-methyl
cagtcggtaagtt

SEQ ID NO: 1323 - DNA, 12 bp, Artificial Sequence
  Description of Artificial Sequence: Synthetic Antisense oligonucleotide
  misc_feature (1)..(1): 5-methyl
  misc_feature (5)..(5): 5-methyl
cagtcggtaagt

SEQ ID NO: 1324 - DNA, 20 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(20): 5-methyl
ccagtcggtaagttctgtcc

SEQ ID NO: 1325 - DNA, 19 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(19): 5-methyl
ccagtcggtaagttctgtc

SEQ ID NO: 1326 - DNA, 18 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
ccagtcggtaagttctgt

SEQ ID NO: 1327 - DNA, 17 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
ccagtcggtaagttctg

SEQ ID NO: 1328 - DNA, 16 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
ccagtcggtaagttct

SEQ ID NO: 1329 - DNA, 15 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
ccagtcggtaagttc

SEQ ID NO: 1330 - DNA, 14 bp, Artificial Sequence
  Description of Artificial Sequence: Synthetic Antisense oligonucleotide
  misc_feature (1)..(2): 5-methyl
  misc_feature (6)..(6): 5-methyl
ccagtcggtaagtt

SEQ ID NO: 1331 - DNA, 13 bp, Artificial Sequence
  Description of Artificial Sequence: Synthetic Antisense oligonucleotide
  misc_feature (1)..(2): 5-methyl
  misc_feature (6)..(6): 5-methyl
ccagtcggtaagt

SEQ ID NO: 1332 - DNA, 20 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
  misc_feature (20)..(20): 5-methyl
gccagtcggtaagttctgtc

SEQ ID NO: 1333 - DNA, 19 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
gccagtcggtaagttctgt

SEQ ID NO: 1334 - DNA, 18 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
gccagtcggtaagttctg

SEQ ID NO: 1335 - DNA, 17 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
gccagtcggtaagttct

SEQ ID NO: 1336 - DNA, 16 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
gccagtcggtaagttc

SEQ ID NO: 1337 - DNA, 15 bp, Artificial Sequence
  Description of Artificial Sequence: Synthetic Antisense oligonucleotide
  misc_feature (2)..(3): 5-methyl
  misc_feature (7)..(7): 5-methyl
gccagtcggtaagtt

SEQ ID NO: 1338 - DNA, 14 bp, Artificial Sequence
  Description of Artificial Sequence: Synthetic Antisense oligonucleotide
  misc_feature (2)..(3): 5-methyl
  misc_feature (7)..(7): 5-methyl
gccagtcggtaagt

SEQ ID NO: 1339 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttct

SEQ ID NO: 1340 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttctag

SEQ ID NO: 1341 - DNA, 16 bp, Artificial Sequence
  Description of Artificial Sequence: Synthetic Antisense oligonucleotide
  misc_feature (2)..(2): 5-methyl
  misc_feature (14)..(14): 5-methyl
tcaaggaagatggcat

SEQ ID NO: 1342 - DNA, 15 bp, Artificial Sequence
  Description of Artificial Sequence: Synthetic Antisense oligonucleotide
  misc_feature (9)..(9): 5-methyl
  misc_feature (14)..(14): 5-methyl
gaagatggcatttct

SEQ ID NO: 1343 - DNA, 21 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttcta

SEQ ID NO: 1344 - DNA, 19 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttc

SEQ ID NO: 1345 - DNA, 18 bp, Artificial Sequence
  Description of Artificial Sequence: Synthetic Antisense oligonucleotide
  misc_feature (2)..(2): 5-methyl
  misc_feature (14)..(14): 5-methyl
tcaaggaagatggcattt

SEQ ID NO: 1346 - DNA, 17 bp, Artificial Sequence
  Description of Artificial Sequence: Synthetic Antisense oligonucleotide
  misc_feature (2)..(2): 5-methyl
  misc_feature (14)..(14): 5-methyl
tcaaggaagatggcatt

SEQ ID NO: 1347 - DNA, 15 bp, Artificial Sequence
  Description of Artificial Sequence: Synthetic Antisense oligonucleotide
  misc_feature (2)..(2): 5-methyl
  misc_feature (14)..(14): 5-methyl
tcaaggaagatggca

SEQ ID NO: 1348 - DNA, 14 bp, Artificial Sequence
  Description of Artificial Sequence: Synthetic Antisense oligonucleotide
  misc_feature (2)..(2): 5-methyl
  misc_feature (14)..(14): 5-methyl
tcaaggaagatggc

SEQ ID NO: 1349 - DNA, 13 bp, Artificial Sequence
  Description of Artificial Sequence: Synthetic Antisense oligonucleotide
  misc_feature (2)..(2): 5-methyl
tcaaggaagatgg

SEQ ID NO: 1350 - DNA, 12 bp, Artificial Sequence
  Description of Artificial Sequence: Synthetic Antisense oligonucleotide
  misc_feature (2)..(2): 5-methyl
tcaaggaagatg

SEQ ID NO: 1351 - DNA, 11 bp, Artificial Sequence
  Description of Artificial Sequence: Synthetic Antisense oligonucleotide
  misc_feature (2)..(2): 5-methyl
tcaaggaagat

SEQ ID NO: 1352 - DNA, 10 bp, Artificial Sequence
  Description of Artificial Sequence: Synthetic Antisense oligonucleotide
  misc_feature (2)..(2): 5-methyl
tcaaggaaga

SEQ ID NO: 1353 - DNA, 9 bp, Artificial Sequence
  Description of Artificial Sequence: Synthetic Antisense oligonucleotide
  misc_feature (2)..(2): 5-methyl
tcaaggaag

SEQ ID NO: 1354 - DNA, 21 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
caaggaagatggcatttctag

SEQ ID NO: 1355 - DNA, 20 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
caaggaagatggcatttcta

SEQ ID NO: 1356 - DNA, 19 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
caaggaagatggcatttct

SEQ ID NO: 1357 - DNA, 18 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
caaggaagatggcatttc

SEQ ID NO: 1358 - DNA, 17 bp, Artificial Sequence
  Description of Artificial Sequence: Synthetic Antisense oligonucleotide
  misc_feature (1)..(1): 5-methyl
  misc_feature (13)..(13): 5-methyl
caaggaagatggcattt

SEQ ID NO: 1359 - DNA, 16 bp, Artificial Sequence
  Description of Artificial Sequence: Synthetic Antisense oligonucleotide
  misc_feature (1)..(1): 5-methyl
  misc_feature (13)..(13): 5-methyl
caaggaagatggcatt

SEQ ID NO: 1360 - DNA, 15 bp, Artificial Sequence
  Description of Artificial Sequence: Synthetic Antisense oligonucleotide
  misc_feature (1)..(1): 5-methyl
  misc_feature (13)..(13): 5-methyl
caaggaagatggcat

SEQ ID NO: 1361 - DNA, 14 bp, Artificial Sequence
  Description of Artificial Sequence: Synthetic Antisense oligonucleotide
  misc_feature (1)..(1): 5-methyl
  misc_feature (13)..(13): 5-methyl
caaggaagatggca

SEQ ID NO: 1362 - DNA, 13 bp, Artificial Sequence
  Description of Artificial Sequence: Synthetic Antisense oligonucleotide
  misc_feature (1)..(1): 5-methyl
  misc_feature (13)..(13): 5-methyl
caaggaagatggc

SEQ ID NO: 1363 - DNA, 12 bp, Artificial Sequence
  Description of Artificial Sequence: Synthetic Antisense oligonucleotide
  misc_feature (1)..(1): 5-methyl
caaggaagatgg

SEQ ID NO: 1364 - DNA, 11 bp, Artificial Sequence
  Description of Artificial Sequence: Synthetic Antisense oligonucleotide
  misc_feature (1)..(1): 5-methyl
caaggaagatg

SEQ ID NO: 1365 - DNA, 10 bp, Artificial Sequence
  Description of Artificial Sequence: Synthetic Antisense oligonucleotide
  misc_feature (1)..(1): 5-methyl
caaggaagat

SEQ ID NO: 1366 - DNA, 20 bp, Artificial Sequence
  Description of Artificial Sequence: Synthetic Antisense oligonucleotide
  misc_feature (12)..(12): 5-methyl
  misc_feature (17)..(17): 5-methyl
aaggaagatggcatttctag

SEQ ID NO: 1367 - DNA, 19 bp, Artificial Sequence
  Description of Artificial Sequence: Synthetic Antisense oligonucleotide
  misc_feature (12)..(12): 5-methyl
  misc_feature (17)..(17): 5-methyl
aaggaagatggcatttcta

SEQ ID NO: 1368 - DNA, 18 bp, Artificial Sequence
  Description of Artificial Sequence: Synthetic Antisense oligonucleotide
  misc_feature (12)..(12): 5-methyl
  misc_feature (17)..(17): 5-methyl
aaggaagatggcatttct

SEQ ID NO: 1369 - DNA, 17 bp, Artificial Sequence
  Description of Artificial Sequence: Synthetic Antisense oligonucleotide
  misc_feature (12)..(12): 5-methyl
  misc_feature (17)..(17): 5-methyl
aaggaagatggcatttc

SEQ ID NO: 1370 - DNA, 16 bp, Artificial Sequence
  Description of Artificial Sequence: Synthetic Antisense oligonucleotide
  misc_feature (12)..(12): 5-methyl
aaggaagatggcattt

SEQ ID NO: 1371 - DNA, 15 bp, Artificial Sequence
  Description of Artificial Sequence: Synthetic Antisense oligonucleotide
  misc_feature (12)..(12): 5-methyl
aaggaagatggcatt

SEQ ID NO: 1372 - DNA, 14 bp, Artificial Sequence
  Description of Artificial Sequence: Synthetic Antisense oligonucleotide
  misc_feature (12)..(12): 5-methyl
aaggaagatggcat

SEQ ID NO: 1373 - DNA, 13 bp, Artificial Sequence
  Description of Artificial Sequence: Synthetic Antisense oligonucleotide
  misc_feature (12)..(12): 5-methyl
aaggaagatggca

SEQ ID NO: 1374 - DNA, 12 bp, Artificial Sequence
  Description of Artificial Sequence: Synthetic Antisense oligonucleotide
  misc_feature (12)..(12): 5-methyl
aaggaagatggc

SEQ ID NO: 1375 - DNA, 19 bp, Artificial Sequence
  Description of Artificial Sequence: Synthetic Antisense oligonucleotide
  misc_feature (11)..(11): 5-methyl
  misc_feature (16)..(16): 5-methyl
aggaagatggcatttctag

SEQ ID NO: 1376 - DNA, 18 bp, Artificial Sequence
  Description of Artificial Sequence: Synthetic Antisense oligonucleotide
  misc_feature (11)..(11): 5-methyl
  misc_feature (16)..(16): 5-methyl
aggaagatggcatttcta

SEQ ID NO: 1377 - DNA, 17 bp, Artificial Sequence
  Description of Artificial Sequence: Synthetic Antisense oligonucleotide
  misc_feature (11)..(11): 5-methyl
  misc_feature (16)..(16): 5-methyl
aggaagatggcatttct

SEQ ID NO: 1378 - DNA, 16 bp, Artificial Sequence
  Description of Artificial Sequence: Synthetic Antisense oligonucleotide
  misc_feature (11)..(11): 5-methyl
  misc_feature (16)..(16): 5-methyl
aggaagatggcatttc

SEQ ID NO: 1379 - DNA, 15 bp, Artificial Sequence
  Description of Artificial Sequence: Synthetic Antisense oligonucleotide
  misc_feature (11)..(11): 5-methyl
aggaagatggcattt

SEQ ID NO: 1380 - DNA, 14 bp, Artificial Sequence
  Description of Artificial Sequence: Synthetic Antisense oligonucleotide
  misc_feature (11)..(11): 5-methyl
aggaagatggcatt

SEQ ID NO: 1381 - DNA, 13 bp, Artificial Sequence
  Description of Artificial Sequence: Synthetic Antisense oligonucleotide
  misc_feature (11)..(11): 5-methyl
aggaagatggcat

SEQ ID NO: 1382 - DNA, 12 bp, Artificial Sequence
  Description of Artificial Sequence: Synthetic Antisense oligonucleotide
  misc_feature (11)..(11): 5-methyl
aggaagatggca

SEQ ID NO: 1383 - DNA, 18 bp, Artificial Sequence
  Description of Artificial Sequence: Synthetic Antisense oligonucleotide
  misc_feature (10)..(10): 5-methyl
  misc_feature (15)..(15): 5-methyl
ggaagatggcatttctag

SEQ ID NO: 1384 - DNA, 17 bp, Artificial Sequence
  Description of Artificial Sequence: Synthetic Antisense oligonucleotide
  misc_feature (10)..(10): 5-methyl
  misc_feature (15)..(15): 5-methyl
ggaagatggcatttcta

SEQ ID NO: 1385 - DNA, 16 bp, Artificial Sequence
  Description of Artificial Sequence: Synthetic Antisense oligonucleotide
  misc_feature (10)..(10): 5-methyl
  misc_feature (15)..(15): 5-methyl
ggaagatggcatttct

SEQ ID NO: 1386 - DNA, 15 bp, Artificial Sequence
  Description of Artificial Sequence: Synthetic Antisense oligonucleotide
  misc_feature (10)..(10): 5-methyl
  misc_feature (15)..(15): 5-methyl
ggaagatggcatttc

SEQ ID NO: 1387 - DNA, 14 bp, Artificial Sequence
  Description of Artificial Sequence: Synthetic Antisense oligonucleotide
  misc_feature (10)..(10): 5-methyl
ggaagatggcattt

SEQ ID NO: 1388 - DNA, 13 bp, Artificial Sequence
  Description of Artificial Sequence: Synthetic Antisense oligonucleotide
  misc_feature (10)..(10): 5-methyl
ggaagatggcatt

SEQ ID NO: 1389 - DNA, 12 bp, Artificial Sequence
  Description of Artificial Sequence: Synthetic Antisense oligonucleotide
  misc_feature (10)..(10): 5-methyl
ggaagatggcat

SEQ ID NO: 1390 - DNA, 11 bp, Artificial Sequence
  Description of Artificial Sequence: Synthetic Antisense oligonucleotide
  misc_feature (10)..(10): 5-methyl
ggaagatggca

SEQ ID NO: 1391 - DNA, 10 bp, Artificial Sequence
  Description of Artificial Sequence: Synthetic Antisense oligonucleotide
  misc_feature (10)..(10): 5-methyl
ggaagatggc

SEQ ID NO: 1392 - DNA, 17 bp, Artificial Sequence
  Description of Artificial Sequence: Synthetic Antisense oligonucleotide
  misc_feature (9)..(9): 5-methyl
  misc_feature (14)..(14): 5-methyl
gaagatggcatttctag

SEQ ID NO: 1393 - DNA, 16 bp, Artificial Sequence
  Description of Artificial Sequence: Synthetic Antisense oligonucleotide
  misc_feature (9)..(9): 5-methyl
  misc_feature (14)..(14): 5-methyl
gaagatggcatttcta

SEQ ID NO: 1394 - DNA, 14 bp, Artificial Sequence
  Description of Artificial Sequence: Synthetic Antisense oligonucleotide
  misc_feature (9)..(9): 5-methyl
  misc_feature (14)..(14): 5-methyl
gaagatggcatttc

SEQ ID NO: 1395 - DNA, 13 bp, Artificial Sequence
  Description of Artificial Sequence: Synthetic Antisense oligonucleotide
  misc_feature (9)..(9): 5-methyl
gaagatggcattt

SEQ ID NO: 1396 - DNA, 12 bp, Artificial Sequence
  Description of Artificial Sequence: Synthetic Antisense oligonucleotide
  misc_feature (9)..(9): 5-methyl
gaagatggcatt

SEQ ID NO: 1397 - DNA, 11 bp, Artificial Sequence
  Description of Artificial Sequence: Synthetic Antisense oligonucleotide
  misc_feature (9)..(9): 5-methyl
gaagatggcat

SEQ ID NO: 1398 - DNA, 10 bp, Artificial Sequence
  Description of Artificial Sequence: Synthetic Antisense oligonucleotide
  misc_feature (9)..(9): 5-methyl
gaagatggca

SEQ ID NO: 1399 - DNA, 9 bp, Artificial Sequence
  Description of Artificial Sequence: Synthetic Antisense oligonucleotide
  misc_feature (9)..(9): 5-methyl
gaagatggc

SEQ ID NO: 1400 - DNA, 16 bp, Artificial Sequence
  Description of Artificial Sequence: Synthetic Antisense oligonucleotide
  misc_feature (8)..(8): 5-methyl
  misc_feature (13)..(13): 5-methyl
aagatggcatttctag

SEQ ID NO: 1401 - DNA, 15 bp, Artificial Sequence
  Description of Artificial Sequence: Synthetic Antisense oligonucleotide
  misc_feature (8)..(8): 5-methyl
  misc_feature (13)..(13): 5-methyl
aagatggcatttcta

SEQ ID NO: 1402 - DNA, 14 bp, Artificial Sequence
  Description of Artificial Sequence: Synthetic Antisense oligonucleotide
  misc_feature (8)..(8): 5-methyl
  misc_feature (13)..(13): 5-methyl
aagatggcatttct

SEQ ID NO: 1403 - DNA, 13 bp, Artificial Sequence
  Description of Artificial Sequence: Synthetic Antisense oligonucleotide
  misc_feature (8)..(8): 5-methyl
  misc_feature (13)..(13): 5-methyl
aagatggcatttc

SEQ ID NO: 1404 - DNA, 12 bp, Artificial Sequence
  Description of Artificial Sequence: Synthetic Antisense oligonucleotide
  misc_feature (8)..(8): 5-methyl
aagatggcattt

SEQ ID NO: 1405 - DNA, 11 bp, Artificial Sequence
  Description of Artificial Sequence: Synthetic Antisense oligonucleotide
  misc_feature (8)..(8): 5-methyl
aagatggcatt

SEQ ID NO: 1406 - DNA, 10 bp, Artificial Sequence
  Description of Artificial Sequence: Synthetic Antisense oligonucleotide
  misc_feature (8)..(8): 5-methyl
aagatggcat

SEQ ID NO: 1407 - DNA, 9 bp, Artificial Sequence
  Description of Artificial Sequence: Synthetic Antisense oligonucleotide
  misc_feature (8)..(8): 5-methyl
aagatggca

SEQ ID NO: 1408 - DNA, 8 bp, Artificial Sequence
  Description of Artificial Sequence: Synthetic Antisense oligonucleotide
  misc_feature (8)..(8): 5-methyl
aagatggc

SEQ ID NO: 1409 - DNA, 15 bp, Artificial Sequence
  Description of Artificial Sequence: Synthetic Antisense oligonucleotide
  misc_feature (7)..(7): 5-methyl
  misc_feature (12)..(12): 5-methyl
agatggcatttctag

SEQ ID NO: 1410 - DNA, 14 bp, Artificial Sequence
  Description of Artificial Sequence: Synthetic Antisense oligonucleotide
  misc_feature (7)..(7): 5-methyl
  misc_feature (12)..(12): 5-methyl
agatggcatttcta

SEQ ID NO: 1411 - DNA, 13 bp, Artificial Sequence
  Description of Artificial Sequence: Synthetic Antisense oligonucleotide
  misc_feature (7)..(7): 5-methyl
  misc_feature (12)..(12): 5-methyl
agatggcatttct

SEQ ID NO: 1412 - DNA, 12 bp, Artificial Sequence
  Description of Artificial Sequence: Synthetic Antisense oligonucleotide
  misc_feature (7)..(7): 5-methyl
  misc_feature (12)..(12): 5-methyl
agatggcatttc

SEQ ID NO: 1413 - DNA, 11 bp, Artificial Sequence
  Description of Artificial Sequence: Synthetic Antisense oligonucleotide
  misc_feature (7)..(7): 5-methyl
agatggcattt

SEQ ID NO: 1414 - DNA, 10 bp, Artificial Sequence
  Description of Artificial Sequence: Synthetic Antisense oligonucleotide
  misc_feature (7)..(7): 5-methyl
agatggcatt

SEQ ID NO: 1415 - DNA, 9 bp, Artificial Sequence
  Description of Artificial Sequence: Synthetic Antisense oligonucleotide
  misc_feature (7)..(7): 5-methyl
agatggcat

SEQ ID NO: 1416 - DNA, 8 bp, Artificial Sequence
  Description of Artificial Sequence: Synthetic Antisense oligonucleotide
  misc_feature (7)..(7): 5-methyl
agatggca

SEQ ID NO: 1417 - DNA, 30 bp, Artificial Sequence; identical to SEQ ID NO: 8
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl

SEQ ID NO: 1418 - DNA, 29 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
ctccaacatcaaggaagatggcatttcta

SEQ ID NO: 1419 - DNA, 28 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
ctccaacatcaaggaagatggcatttct

SEQ ID NO: 1420 - DNA, 27 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
ctccaacatcaaggaagatggcatttc

SEQ ID NO: 1421 - DNA, 26 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
ctccaacatcaaggaagatggcattt

SEQ ID NO: 1422 - DNA, 25 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
ctccaacatcaaggaagatggcatt

SEQ ID NO: 1423 - DNA, 24 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
ctccaacatcaaggaagatggcat

SEQ ID NO: 1424 - DNA, 23 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
ctccaacatcaaggaagatggca

SEQ ID NO: 1425 - DNA, 22 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
ctccaacatcaaggaagatggc

SEQ ID NO: 1426 - DNA, 21 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
ctccaacatcaaggaagatgg

SEQ ID NO: 1427 - DNA, 20 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
ctccaacatcaaggaagatg

SEQ ID NO: 1428 - DNA, 19 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
ctccaacatcaaggaagat

SEQ ID NO: 1429 - DNA, 18 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
ctccaacatcaaggaaga

SEQ ID NO: 1430 - DNA, 17 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
ctccaacatcaaggaag

SEQ ID NO: 1431 - DNA, 29 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttctag

SEQ ID NO: 1432 - DNA, 28 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttcta

SEQ ID NO: 1433 - DNA, 27 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttct

SEQ ID NO: 1434 - DNA, 26 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttc

SEQ ID NO: 1435 - DNA, 25 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggcattt

SEQ ID NO: 1436 - DNA, 24 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggcatt

SEQ ID NO: 1437 - DNA, 23 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggcat

SEQ ID NO: 1438 - DNA, 22 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggca

SEQ ID NO: 1439 - DNA, 21 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggc

SEQ ID NO: 1440 - DNA, 20 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
tccaacatcaaggaagatgg

SEQ ID NO: 1441 - DNA, 19 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
tccaacatcaaggaagatg

SEQ ID NO: 1442 - DNA, 18 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
tccaacatcaaggaagat

SEQ ID NO: 1443 - DNA, 17 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
tccaacatcaaggaaga

SEQ ID NO: 1444 - DNA, 16 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
tccaacatcaaggaag

SEQ ID NO: 1445 - DNA, 28 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
ccaacatcaaggaagatggcatttctag

SEQ ID NO: 1446 - DNA, 27 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
ccaacatcaaggaagatggcatttcta

SEQ ID NO: 1447 - DNA, 26 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
ccaacatcaaggaagatggcatttct

SEQ ID NO: 1448 - DNA, 25 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
ccaacatcaaggaagatggcatttc

SEQ ID NO: 1449 - DNA, 24 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
ccaacatcaaggaagatggcattt

SEQ ID NO: 1450 - DNA, 23 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
ccaacatcaaggaagatggcatt

SEQ ID NO: 1451 - DNA, 22 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
ccaacatcaaggaagatggcat

SEQ ID NO: 1452 - DNA, 21 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
ccaacatcaaggaagatggca

SEQ ID NO: 1453 - DNA, 20 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
ccaacatcaaggaagatggc

SEQ ID NO: 1454 - DNA, 19 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
ccaacatcaaggaagatgg

SEQ ID NO: 1455 - DNA, 18 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
ccaacatcaaggaagatg

SEQ ID NO: 1456 - DNA, 17 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
ccaacatcaaggaagat

SEQ ID NO: 1457 - DNA, 16 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
ccaacatcaaggaaga

SEQ ID NO: 1458 - DNA, 15 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
ccaacatcaaggaag

SEQ ID NO: 1459 - DNA, 27 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
caacatcaaggaagatggcatttctag

SEQ ID NO: 1460 - DNA, 26 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
caacatcaaggaagatggcatttcta

SEQ ID NO: 1461 - DNA, 25 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
caacatcaaggaagatggcatttct

SEQ ID NO: 1462 - DNA, 24 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
caacatcaaggaagatggcatttc

SEQ ID NO: 1463 - DNA, 23 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
caacatcaaggaagatggcattt

SEQ ID NO: 1464 - DNA, 22 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
caacatcaaggaagatggcatt

SEQ ID NO: 1465 - DNA, 21 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
caacatcaaggaagatggcat

SEQ ID NO: 1466 - DNA, 20 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
caacatcaaggaagatggca

SEQ ID NO: 1467 - DNA, 19 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
caacatcaaggaagatggc

SEQ ID NO: 1468 - DNA, 18 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
caacatcaaggaagatgg

SEQ ID NO: 1469 - DNA, 17 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
caacatcaaggaagatg

SEQ ID NO: 1470 - DNA, 16 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
caacatcaaggaagat

SEQ ID NO: 1471 - DNA, 15 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
caacatcaaggaaga

SEQ ID NO: 1472 - DNA, 14 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
caacatcaaggaag

SEQ ID NO: 1473 - DNA, 26 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttctag

SEQ ID NO: 1474 - DNA, 25 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttcta

SEQ ID NO: 1475 - DNA, 24 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttct

SEQ ID NO: 1476 - DNA, 23 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttc

SEQ ID NO: 1477 - DNA, 22 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
aacatcaaggaagatggcattt

SEQ ID NO: 1478 - DNA, 21 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
aacatcaaggaagatggcatt

SEQ ID NO: 1479 - DNA, 20 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
aacatcaaggaagatggcat

SEQ ID NO: 1480 - DNA, 19 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
aacatcaaggaagatggca

SEQ ID NO: 1481 - DNA, 18 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
aacatcaaggaagatggc

SEQ ID NO: 1482 - DNA, 17 bp, Artificial Sequence
  Description of Artificial Sequence: Synthetic Antisense oligonucleotide
  misc_feature (3)..(3): 5-methyl
  misc_feature (6)..(6): 5-methyl
aacatcaaggaagatgg

SEQ ID NO: 1483 - DNA, 16 bp, Artificial Sequence
  Description of Artificial Sequence: Synthetic Antisense oligonucleotide
  misc_feature (3)..(3): 5-methyl
  misc_feature (6)..(6): 5-methyl
aacatcaaggaagatg

SEQ ID NO: 1484 - DNA, 15 bp, Artificial Sequence
  Description of Artificial Sequence: Synthetic Antisense oligonucleotide
  misc_feature (3)..(3): 5-methyl
  misc_feature (6)..(6): 5-methyl
aacatcaaggaagat

SEQ ID NO: 1485 - DNA, 14 bp, Artificial Sequence
  Description of Artificial Sequence: Synthetic Antisense oligonucleotide
  misc_feature (3)..(3): 5-methyl
  misc_feature (6)..(6): 5-methyl
aacatcaaggaaga

SEQ ID NO: 1486 - DNA, 13 bp, Artificial Sequence
  Description of Artificial Sequence: Synthetic Antisense oligonucleotide
  misc_feature (3)..(3): 5-methyl
  misc_feature (6)..(6): 5-methyl
aacatcaaggaag

SEQ ID NO: 1487 - DNA, 25 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttctag

SEQ ID NO: 1488 - DNA, 24 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttcta

SEQ ID NO: 1489 - DNA, 23 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttct

SEQ ID NO: 1490 - DNA, 22 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttc

SEQ ID NO: 1491 - DNA, 21 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
acatcaaggaagatggcattt

SEQ ID NO: 1492 - DNA, 20 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
acatcaaggaagatggcatt

SEQ ID NO: 1493 - DNA, 19 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
acatcaaggaagatggcat

SEQ ID NO: 1494 - DNA, 18 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
acatcaaggaagatggca

SEQ ID NO: 1495 - DNA, 17 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
acatcaaggaagatggc

SEQ ID NO: 1496 - DNA, 16 bp, Artificial Sequence
  Description of Artificial Sequence: Synthetic Antisense oligonucleotide
  misc_feature (2)..(2): 5-methyl
  misc_feature (5)..(5): 5-methyl
acatcaaggaagatgg

SEQ ID NO: 1497 - DNA, 15 bp, Artificial Sequence
  Description of Artificial Sequence: Synthetic Antisense oligonucleotide
  misc_feature (2)..(2): 5-methyl
  misc_feature (5)..(5): 5-methyl
acatcaaggaagatg

SEQ ID NO: 1498 - DNA, 14 bp, Artificial Sequence
  Description of Artificial Sequence: Synthetic Antisense oligonucleotide
  misc_feature (2)..(2): 5-methyl
  misc_feature (5)..(5): 5-methyl
acatcaaggaagat

SEQ ID NO: 1499 - DNA, 13 bp, Artificial Sequence
  Description of Artificial Sequence: Synthetic Antisense oligonucleotide
  misc_feature (2)..(2): 5-methyl
  misc_feature (5)..(5): 5-methyl
acatcaaggaaga

SEQ ID NO: 1500 - DNA, 12 bp, Artificial Sequence
  Description of Artificial Sequence: Synthetic Antisense oligonucleotide
  misc_feature (2)..(2): 5-methyl
  misc_feature (5)..(5): 5-methyl
acatcaaggaag

SEQ ID NO: 1501 - DNA, 24 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
catcaaggaagatggcatttctag

SEQ ID NO: 1502 - DNA, 23 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
catcaaggaagatggcatttcta

SEQ ID NO: 1503 - DNA, 22 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
catcaaggaagatggcatttct

SEQ ID NO: 1504 - DNA, 21 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
catcaaggaagatggcatttc

SEQ ID NO: 1505 - DNA, 20 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
catcaaggaagatggcattt

SEQ ID NO: 1506 - DNA, 19 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
catcaaggaagatggcatt

SEQ ID NO: 1507 - DNA, 18 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
catcaaggaagatggcat

SEQ ID NO: 1508 - DNA, 17 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
catcaaggaagatggca

SEQ ID NO: 1509 - DNA, 16 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
catcaaggaagatggc

SEQ ID NO: 1510 - DNA, 15 bp, Artificial Sequence
  Description of Artificial Sequence: Synthetic Antisense oligonucleotide
  misc_feature (1)..(1): 5-methyl
  misc_feature (4)..(4): 5-methyl
catcaaggaagatgg

SEQ ID NO: 1511 - DNA, 14 bp, Artificial Sequence
  Description of Artificial Sequence: Synthetic Antisense oligonucleotide
  misc_feature (1)..(1): 5-methyl
  misc_feature (4)..(4): 5-methyl
catcaaggaagatg

SEQ ID NO: 1512 - DNA, 13 bp, Artificial Sequence
  Description of Artificial Sequence: Synthetic Antisense oligonucleotide
  misc_feature (1)..(1): 5-methyl
  misc_feature (4)..(4): 5-methyl
catcaaggaagat

SEQ ID NO: 1513 - DNA, 12 bp, Artificial Sequence
  Description of Artificial Sequence: Synthetic Antisense oligonucleotide
  misc_feature (1)..(1): 5-methyl
  misc_feature (4)..(4): 5-methyl
catcaaggaaga

SEQ ID NO: 1514 - DNA, 11 bp, Artificial Sequence
  Description of Artificial Sequence: Synthetic Antisense oligonucleotide
  misc_feature (1)..(1): 5-methyl
  misc_feature (4)..(4): 5-methyl
catcaaggaag

SEQ ID NO: 1515 - DNA, 23 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
atcaaggaagatggcatttctag

SEQ ID NO: 1516 - DNA, 22 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
atcaaggaagatggcatttcta

SEQ ID NO: 1517 - DNA, 21 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
atcaaggaagatggcatttct

SEQ ID NO: 1518 - DNA, 20 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
atcaaggaagatggcatttc

SEQ ID NO: 1519 - DNA, 19 bp, Artificial Sequence
  Description of Artificial Sequence: Synthetic Antisense oligonucleotide
  misc_feature (3)..(3): 5-methyl
  misc_feature (15)..(15): 5-methyl
atcaaggaagatggcattt

SEQ ID NO: 1520 - DNA, 18 bp, Artificial Sequence
  Description of Artificial Sequence: Synthetic Antisense oligonucleotide
  misc_feature (3)..(3): 5-methyl
  misc_feature (15)..(15): 5-methyl
atcaaggaagatggcatt

SEQ ID NO: 1521 - DNA, 17 bp, Artificial Sequence
  Description of Artificial Sequence: Synthetic Antisense oligonucleotide
  misc_feature (3)..(3): 5-methyl
  misc_feature (15)..(15): 5-methyl
atcaaggaagatggcat

SEQ ID NO: 1522 - DNA, 16 bp, Artificial Sequence
  Description of Artificial Sequence: Synthetic Antisense oligonucleotide
  misc_feature (3)..(3): 5-methyl
  misc_feature (15)..(15): 5-methyl
atcaaggaagatggca

SEQ ID NO: 1523 - DNA, 15 bp, Artificial Sequence
  Description of Artificial Sequence: Synthetic Antisense oligonucleotide
  misc_feature (3)..(3): 5-methyl
  misc_feature (15)..(15): 5-methyl
atcaaggaagatggc

SEQ ID NO: 1524 - DNA, 14 bp, Artificial Sequence
  Description of Artificial Sequence: Synthetic Antisense oligonucleotide
  misc_feature (3)..(3): 5-methyl
atcaaggaagatgg

SEQ ID NO: 1525 - DNA, 13 bp, Artificial Sequence
  Description of Artificial Sequence: Synthetic Antisense oligonucleotide
  misc_feature (3)..(3): 5-methyl
atcaaggaagatg

SEQ ID NO: 1526 - DNA, 12 bp, Artificial Sequence
  Description of Artificial Sequence: Synthetic Antisense oligonucleotide
  misc_feature (3)..(3): 5-methyl
atcaaggaagat

SEQ ID NO: 1527 - DNA, 11 bp, Artificial Sequence
  Description of Artificial Sequence: Synthetic Antisense oligonucleotide
  misc_feature (3)..(3): 5-methyl
atcaaggaaga

SEQ ID NO: 1528 - DNA, 10 bp, Artificial Sequence
  Description of Artificial Sequence: Synthetic Antisense oligonucleotide
  misc_feature (3)..(3): 5-methyl
atcaaggaag

SEQ ID NO: 1529 - RNA, 18 nt, Artificial Sequence
  Description of Artificial Sequence: Synthetic Antisense oligonucleotide
  misc_feature (1)..(1): bicyclic nucleic acid (BNA)
gguaaguucuguccaagc

SEQ ID NO: 1530 - RNA, 18 nt, Artificial Sequence
  Description of Artificial Sequence: Synthetic Antisense oligonucleotide
  misc_feature (1)..(1): bicyclic nucleic acid (BNA)
guaaguucuguccaagcc

SEQ ID NO: 1531 - RNA, 18 nt, Artificial Sequence
  Description of Artificial Sequence: Synthetic Antisense oligonucleotide
  misc_feature (1)..(1): bicyclic nucleic acid (BNA)
agucgguaaguucugucc

SEQ ID NO: 1532 - RNA, 18 nt, Artificial Sequence
  Description of Artificial Sequence: Synthetic Antisense oligonucleotide
  misc_feature (1)..(1): bicyclic nucleic acid (BNA)
cuguccaagcccgguuga

SEQ ID NO: 1533 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
taaguucuguccaag

SEQ ID NO: 1534 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tucuguccaagcccgguuga

SEQ ID NO: 1535 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tucuguccaagcccgguug

SEQ ID NO: 1536 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tucuguccaagcccgguu

SEQ ID NO: 1537 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tucuguccaagcccggu

SEQ ID NO: 1538 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tucuguccaagcccgg

SEQ ID NO: 1539 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tucuguccaagcccg

SEQ ID NO: 1540 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tucuguccaagccc

SEQ ID NO: 1541 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tucuguccaagcc

SEQ ID NO: 1542 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tucuguccaagc

SEQ ID NO: 1543 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tucuguccaag

SEQ ID NO: 1544 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tucuguccaa

SEQ ID NO: 1545 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tucugucca

SEQ ID NO: 1546 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tucugucc

SEQ ID NO: 1547 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcuguccaagcccgguuga

SEQ ID NO: 1548 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcuguccaagcccgguug

SEQ ID NO: 1549 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcuguccaagcccgguu

SEQ ID NO: 1550 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcuguccaagcccggu

SEQ ID NO: 1551 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcuguccaagcccgg

SEQ ID NO: 1552 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcuguccaagcccg

SEQ ID NO: 1553 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcuguccaagccc

SEQ ID NO: 1554 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcuguccaagcc

SEQ ID NO: 1555 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcuguccaagc

SEQ ID NO: 1556 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcuguccaag

SEQ ID NO: 1557 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcuguccaa

SEQ ID NO: 1558 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcugucca

SEQ ID NO: 1559 - RNA, 17 nt, Artificial Sequence
  Description of Artificial Sequence: Synthetic Antisense oligonucleotide
  misc_feature (1)..(1): bicyclic nucleic acid (BNA)
cuguccaagcccgguug

SEQ ID NO: 1560 - RNA, 16 nt, Artificial Sequence
  Description of Artificial Sequence: Synthetic Antisense oligonucleotide
  misc_feature (1)..(1): bicyclic nucleic acid (BNA)
cuguccaagcccgguu

SEQ ID NO: 1561 - RNA, 15 nt, Artificial Sequence
  Description of Artificial Sequence: Synthetic Antisense oligonucleotide
  misc_feature (1)..(1): bicyclic nucleic acid (BNA)
cuguccaagcccggu

SEQ ID NO: 1562 - RNA, 14 nt, Artificial Sequence
  Description of Artificial Sequence: Synthetic Antisense oligonucleotide
  misc_feature (1)..(1): bicyclic nucleic acid (BNA)
cuguccaagcccgg

SEQ ID NO: 1563 - RNA, 13 nt, Artificial Sequence
  Description of Artificial Sequence: Synthetic Antisense oligonucleotide
  misc_feature (1)..(1): bicyclic nucleic acid (BNA)
cuguccaagcccg

SEQ ID NO: 1564 - RNA, 12 nt, Artificial Sequence
  Description of Artificial Sequence: Synthetic Antisense oligonucleotide
  misc_feature (1)..(1): bicyclic nucleic acid (BNA)
cuguccaagccc

SEQ ID NO: 1565 - RNA, 11 nt, Artificial Sequence
  Description of Artificial Sequence: Synthetic Antisense oligonucleotide
  misc_feature (1)..(1): bicyclic nucleic acid (BNA)
cuguccaagcc

SEQ ID NO: 1566 - RNA, 10 nt, Artificial Sequence
  Description of Artificial Sequence: Synthetic Antisense oligonucleotide
  misc_feature (1)..(1): bicyclic nucleic acid (BNA)
cuguccaagc

SEQ ID NO: 1567 - RNA, 9 nt, Artificial Sequence
  Description of Artificial Sequence: Synthetic Antisense oligonucleotide
  misc_feature (1)..(1): bicyclic nucleic acid (BNA)
cuguccaag

SEQ ID NO: 1568 - RNA, 8 nt, Artificial Sequence
  Description of Artificial Sequence: Synthetic Antisense oligonucleotide
  misc_feature (1)..(1): bicyclic nucleic acid (BNA)
cuguccaa

SEQ ID NO: 1569 - RNA, 20 nt, Artificial Sequence
  Description of Artificial Sequence: Synthetic Antisense oligonucleotide
  misc_feature (1)..(1): bicyclic nucleic acid (BNA)
guucuguccaagcccgguug

SEQ ID NO: 1570 - RNA, 19 nt, Artificial Sequence
  Description of Artificial Sequence: Synthetic Antisense oligonucleotide
  misc_feature (1)..(1): bicyclic nucleic acid (BNA)
guucuguccaagcccgguu

SEQ ID NO: 1571 - RNA, 18 nt, Artificial Sequence
  Description of Artificial Sequence: Synthetic Antisense oligonucleotide
  misc_feature (1)..(1): bicyclic nucleic acid (BNA)
guucuguccaagcccggu

SEQ ID NO: 1572 - RNA, 17 nt, Artificial Sequence
  Description of Artificial Sequence: Synthetic Antisense oligonucleotide
  misc_feature (1)..(1): bicyclic nucleic acid (BNA)
guucuguccaagcccgg

SEQ ID NO: 1573 - RNA, 16 nt, Artificial Sequence
  Description of Artificial Sequence: Synthetic Antisense oligonucleotide
  misc_feature (1)..(1): bicyclic nucleic acid (BNA)
guucuguccaagcccg

SEQ ID NO: 1574 - RNA, 15 nt, Artificial Sequence
  Description of Artificial Sequence: Synthetic Antisense oligonucleotide
  misc_feature (1)..(1): bicyclic nucleic acid (BNA)
guucuguccaagccc

SEQ ID NO: 1575 - RNA, 14 nt, Artificial Sequence
  Description of Artificial Sequence: Synthetic Antisense oligonucleotide
  misc_feature (1)..(1): bicyclic nucleic acid (BNA)
guucuguccaagcc

SEQ ID NO: 1576 - RNA, 13 nt, Artificial Sequence
  Description of Artificial Sequence: Synthetic Antisense oligonucleotide
  misc_feature (1)..(1): bicyclic nucleic acid (BNA)
guucuguccaagc

SEQ ID NO: 1577 - RNA, 12 nt, Artificial Sequence
  Description of Artificial Sequence: Synthetic Antisense oligonucleotide
  misc_feature (1)..(1): bicyclic nucleic acid (BNA)
guucuguccaag

SEQ ID NO: 1578 - RNA, 11 nt, Artificial Sequence
  Description of Artificial Sequence: Synthetic Antisense oligonucleotide
  misc_feature (1)..(1): bicyclic nucleic acid (BNA)
guucuguccaa

SEQ ID NO: 1579 - RNA, 10 nt, Artificial Sequence
  Description of Artificial Sequence: Synthetic Antisense oligonucleotide
  misc_feature (1)..(1): bicyclic nucleic acid (BNA)
guucugucca

SEQ ID NO: 1580 - RNA, 9 nt, Artificial Sequence
  Description of Artificial Sequence: Synthetic Antisense oligonucleotide
  misc_feature (1)..(1): bicyclic nucleic acid (BNA)
guucugucc

SEQ ID NO: 1581 - RNA, 8 nt, Artificial Sequence
  Description of Artificial Sequence: Synthetic Antisense oligonucleotide
  misc_feature (1)..(1): bicyclic nucleic acid (BNA)
guucuguc

SEQ ID NO: 1582 - RNA, 20 nt, Artificial Sequence
  Description of Artificial Sequence: Synthetic Antisense oligonucleotide
  misc_feature (1)..(1): bicyclic nucleic acid (BNA)
aguucuguccaagcccgguu

SEQ ID NO: 1583 - RNA, 19 nt, Artificial Sequence
  Description of Artificial Sequence: Synthetic Antisense oligonucleotide
  misc_feature (1)..(1): bicyclic nucleic acid (BNA)
aguucuguccaagcccggu

SEQ ID NO: 1584 - RNA, 18 nt, Artificial Sequence
  Description of Artificial Sequence: Synthetic Antisense oligonucleotide
  misc_feature (1)..(1): bicyclic nucleic acid (BNA)
aguucuguccaagcccgg

SEQ ID NO: 1585 - RNA, 17 nt, Artificial Sequence
  Description of Artificial Sequence: Synthetic Antisense oligonucleotide
  misc_feature (1)..(1): bicyclic nucleic acid (BNA)
aguucuguccaagcccg

SEQ ID NO: 1586 - RNA, 16 nt, Artificial Sequence
  Description of Artificial Sequence: Synthetic Antisense oligonucleotide
  misc_feature (1)..(1): bicyclic nucleic acid (BNA)
aguucuguccaagccc

SEQ ID NO: 1587 - RNA, 15 nt, Artificial Sequence
  Description of Artificial Sequence: Synthetic Antisense oligonucleotide
  misc_feature (1)..(1): bicyclic nucleic acid (BNA)
aguucuguccaagcc

SEQ ID NO: 1588 - RNA, 14 nt, Artificial Sequence
  Description of Artificial Sequence: Synthetic Antisense oligonucleotide
  misc_feature (1)..(1): bicyclic nucleic acid (BNA)
aguucuguccaagc

SEQ ID NO: 1589 - RNA, 13 nt, Artificial Sequence
  Description of Artificial Sequence: Synthetic Antisense oligonucleotide
  misc_feature (1)..(1): bicyclic nucleic acid (BNA)
aguucuguccaag

SEQ ID NO: 1590 - RNA, 12 nt, Artificial Sequence
  Description of Artificial Sequence: Synthetic Antisense oligonucleotide
  misc_feature (1)..(1): bicyclic nucleic acid (BNA)
aguucuguccaa

SEQ ID NO: 1591 - RNA, 11 nt, Artificial Sequence
  Description of Artificial Sequence: Synthetic Antisense oligonucleotide
  misc_feature (1)..(1): bicyclic nucleic acid (BNA)
aguucugucca

SEQ ID NO: 1592 - RNA, 10 nt, Artificial Sequence
  Description of Artificial Sequence: Synthetic Antisense oligonucleotide
  misc_feature (1)..(1): bicyclic nucleic acid (BNA)
aguucugucc

SEQ ID NO: 1593 - RNA, 9 nt, Artificial Sequence
  Description of Artificial Sequence: Synthetic Antisense oligonucleotide
  misc_feature (1)..(1): bicyclic nucleic acid (BNA)
aguucuguc

SEQ ID NO: 1594 - RNA, 8 nt, Artificial Sequence
  Description of Artificial Sequence: Synthetic Antisense oligonucleotide
  misc_feature (1)..(1): bicyclic nucleic acid (BNA)
aguucugu

SEQ ID NO: 1595 - RNA, 20 nt, Artificial Sequence
  Description of Artificial Sequence: Synthetic Antisense oligonucleotide
  misc_feature (1)..(1): bicyclic nucleic acid (BNA)
aaguucuguccaagcccggu

SEQ ID NO: 1596 - RNA, 19 nt, Artificial Sequence
  Description of Artificial Sequence: Synthetic Antisense oligonucleotide
  misc_feature (1)..(1): bicyclic nucleic acid (BNA)
aaguucuguccaagcccgg

SEQ ID NO: 1597 - RNA, 18 nt, Artificial Sequence
  Description of Artificial Sequence: Synthetic Antisense oligonucleotide
  misc_feature (1)..(1): bicyclic nucleic acid (BNA)
aaguucuguccaagcccg

SEQ ID NO: 1598 - RNA, 17 nt, Artificial Sequence
  Description of Artificial Sequence: Synthetic Antisense oligonucleotide
  misc_feature (1)..(1): bicyclic nucleic acid (BNA)
aaguucuguccaagccc

SEQ ID NO: 1599 - RNA, 16 nt, Artificial Sequence
  Description of Artificial Sequence: Synthetic Antisense oligonucleotide
  misc_feature (1)..(1): bicyclic nucleic acid (BNA)
aaguucuguccaagcc

SEQ ID NO: 1600 - RNA, 15 nt, Artificial Sequence
  Description of Artificial Sequence: Synthetic Antisense oligonucleotide
  misc_feature (1)..(1): bicyclic nucleic acid (BNA)
aaguucuguccaagc

SEQ ID NO: 1601 - RNA, 14 nt, Artificial Sequence
  Description of Artificial Sequence: Synthetic Antisense oligonucleotide
  misc_feature (1)..(1): bicyclic nucleic acid (BNA)
aaguucuguccaag

SEQ ID NO: 1602 - RNA, 13 nt, Artificial Sequence
  Description of Artificial Sequence: Synthetic Antisense oligonucleotide
  misc_feature (1)..(1): bicyclic nucleic acid (BNA)
aaguucuguccaa

SEQ ID NO: 1603 - RNA, 12 nt, Artificial Sequence
  Description of Artificial Sequence: Synthetic Antisense oligonucleotide
  misc_feature (1)..(1): bicyclic nucleic acid (BNA)
aaguucugucca

SEQ ID NO: 1604 - RNA, 11 nt, Artificial Sequence
  Description of Artificial Sequence: Synthetic Antisense oligonucleotide
  misc_feature (1)..(1): bicyclic nucleic acid (BNA)
aaguucugucc

SEQ ID NO: 1605 - RNA, 10 nt, Artificial Sequence
  Description of Artificial Sequence: Synthetic Antisense oligonucleotide
  misc_feature (1)..(1): bicyclic nucleic acid (BNA)
aaguucuguc

SEQ ID NO: 1606 - RNA, 9 nt, Artificial Sequence
  Description of Artificial Sequence: Synthetic Antisense oligonucleotide
  misc_feature (1)..(1): bicyclic nucleic acid (BNA)
aaguucugu

SEQ ID NO: 1607 - RNA, 8 nt, Artificial Sequence
  Description of Artificial Sequence: Synthetic Antisense oligonucleotide
  misc_feature (1)..(1): bicyclic nucleic acid (BNA)
aaguucug

SEQ ID NO: 1608 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
taaguucuguccaagcccgg

SEQ ID NO: 1609 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
taaguucuguccaagcccg

SEQ ID NO: 1610 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
taaguucuguccaagccc

SEQ ID NO: 1611 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
taaguucuguccaagcc

SEQ ID NO: 1612 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
taaguucuguccaagc

SEQ ID NO: 1613 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
taaguucuguccaa

SEQ ID NO: 1614 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
taaguucugucca

SEQ ID NO: 1615 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
taaguucugucc

SEQ ID NO: 1616 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
taaguucuguc

SEQ ID NO: 1617 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
taaguucugu

SEQ ID NO: 1618 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
taaguucug

SEQ ID NO: 1619 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
taaguucu

SEQ ID NO: 1620 - RNA, 20 nt, Artificial Sequence
  Description of Artificial Sequence: Synthetic Antisense oligonucleotide
  misc_feature (1)..(1): bicyclic nucleic acid (BNA)
guaaguucuguccaagcccg

SEQ ID NO: 1621 - RNA, 19 nt, Artificial Sequence
  Description of Artificial Sequence: Synthetic Antisense oligonucleotide
  misc_feature (1)..(1): bicyclic nucleic acid (BNA)
guaaguucuguccaagccc

SEQ ID NO: 1622 - RNA, 17 nt, Artificial Sequence
  Description of Artificial Sequence: Synthetic Antisense oligonucleotide
  misc_feature (1)..(1): bicyclic nucleic acid (BNA)
guaaguucuguccaagc

SEQ ID NO: 1623 - RNA, 16 nt, Artificial Sequence
  Description of Artificial Sequence: Synthetic Antisense oligonucleotide
  misc_feature (1)..(1): bicyclic nucleic acid (BNA)
guaaguucuguccaag

SEQ ID NO: 1624 - RNA, 15 nt, Artificial Sequence
  Description of Artificial Sequence: Synthetic Antisense oligonucleotide
  misc_feature (1)..(1): bicyclic nucleic acid (BNA)
guaaguucuguccaa

SEQ ID NO: 1625 - RNA, 14 nt, Artificial Sequence
  Description of Artificial Sequence: Synthetic Antisense oligonucleotide
  misc_feature (1)..(1): bicyclic nucleic acid (BNA)
guaaguucugucca

SEQ ID NO: 1626 - RNA, 13 nt, Artificial Sequence
  Description of Artificial Sequence: Synthetic Antisense oligonucleotide
  misc_feature (1)..(1): bicyclic nucleic acid (BNA)
guaaguucugucc

SEQ ID NO: 1627 - RNA, 12 nt, Artificial Sequence
  Description of Artificial Sequence: Synthetic Antisense oligonucleotide
  misc_feature (1)..(1): bicyclic nucleic acid (BNA)
guaaguucuguc

SEQ ID NO: 1628 - RNA, 11 nt, Artificial Sequence
  Description of Artificial Sequence: Synthetic Antisense oligonucleotide
  misc_feature (1)..(1): bicyclic nucleic acid (BNA)
guaaguucugu

SEQ ID NO: 1629 - RNA, 10 nt, Artificial Sequence
  Description of Artificial Sequence: Synthetic Antisense oligonucleotide
  misc_feature (1)..(1): bicyclic nucleic acid (BNA)
guaaguucug

SEQ ID NO: 1630 - RNA, 9 nt, Artificial Sequence
  Description of Artificial Sequence: Synthetic Antisense oligonucleotide
  misc_feature (1)..(1): bicyclic nucleic acid (BNA)
guaaguucu

SEQ ID NO: 1631 - RNA, 8 nt, Artificial Sequence
  Description of Artificial Sequence: Synthetic Antisense oligonucleotide
  misc_feature (1)..(1): bicyclic nucleic acid (BNA)
guaaguuc

SEQ ID NO: 1632 - RNA, 20 nt, Artificial Sequence
  Description of Artificial Sequence: Synthetic Antisense oligonucleotide
  misc_feature (1)..(1): bicyclic nucleic acid (BNA)
gguaaguucuguccaagccc

SEQ ID NO: 1633 - RNA, 19 nt, Artificial Sequence
  Description of Artificial Sequence: Synthetic Antisense oligonucleotide
  misc_feature (1)..(1): bicyclic nucleic acid (BNA)
gguaaguucuguccaagcc

SEQ ID NO: 1634 - RNA, 17 nt, Artificial Sequence
  Description of Artificial Sequence: Synthetic Antisense oligonucleotide
  misc_feature (1)..(1): bicyclic nucleic acid (BNA)
gguaaguucuguccaag

SEQ ID NO: 1635 - RNA, 16 nt, Artificial Sequence
  Description of Artificial Sequence: Synthetic Antisense oligonucleotide
  misc_feature (1)..(1): bicyclic nucleic acid (BNA)
gguaaguucuguccaa

SEQ ID NO: 1636 - RNA, 15 nt, Artificial Sequence
  Description of Artificial Sequence: Synthetic Antisense oligonucleotide
  misc_feature (1)..(1): bicyclic nucleic acid (BNA)
gguaaguucugucca

SEQ ID NO: 1637 - RNA, 14 nt, Artificial Sequence
  Description of Artificial Sequence: Synthetic Antisense oligonucleotide
  misc_feature (1)..(1): bicyclic nucleic acid (BNA)
gguaaguucugucc

SEQ ID NO: 1638 - RNA, 13 nt, Artificial Sequence
  Description of Artificial Sequence: Synthetic Antisense oligonucleotide
  misc_feature (1)..(1): bicyclic nucleic acid (BNA)
gguaaguucuguc

SEQ ID NO: 1639 - RNA, 12 nt, Artificial Sequence
  Description of Artificial Sequence: Synthetic Antisense oligonucleotide
  misc_feature (1)..(1): bicyclic nucleic acid (BNA)
gguaaguucugu

SEQ ID NO: 1640 - RNA, 11 nt, Artificial Sequence
  Description of Artificial Sequence: Synthetic Antisense oligonucleotide
  misc_feature (1)..(1): bicyclic nucleic acid (BNA)
gguaaguucug

SEQ ID NO: 1641 - RNA, 10 nt, Artificial Sequence
  Description of Artificial Sequence: Synthetic Antisense oligonucleotide
  misc_feature (1)..(1): bicyclic nucleic acid (BNA)
gguaaguucu

SEQ ID NO: 1642 - RNA, 9 nt, Artificial Sequence
  Description of Artificial Sequence: Synthetic Antisense oligonucleotide
  misc_feature (1)..(1): bicyclic nucleic acid (BNA)
gguaaguuc

SEQ ID NO: 1643 - RNA, 8 nt, Artificial Sequence
  Description of Artificial Sequence: Synthetic Antisense oligonucleotide
  misc_feature (1)..(1): bicyclic nucleic acid (BNA)
gguaaguu

SEQ ID NO: 1644 - RNA, 20 nt, Artificial Sequence
  Description of Artificial Sequence: Synthetic Antisense oligonucleotide
  misc_feature (1)..(1): bicyclic nucleic acid (BNA)
cgguaaguucuguccaagcc

SEQ ID NO: 1645 - RNA, 19 nt, Artificial Sequence
  Description of Artificial Sequence: Synthetic Antisense oligonucleotide
  misc_feature (1)..(1): bicyclic nucleic acid (BNA)
cgguaaguucuguccaagc

SEQ ID NO: 1646 - RNA, 18 nt, Artificial Sequence
  Description of Artificial Sequence: Synthetic Antisense oligonucleotide
  misc_feature (1)..(1): bicyclic nucleic acid (BNA)
cgguaaguucuguccaag

SEQ ID NO: 1647 - RNA, 17 nt, Artificial Sequence
  Description of Artificial Sequence: Synthetic Antisense oligonucleotide
  misc_feature (1)..(1): bicyclic nucleic acid (BNA)
cgguaaguucuguccaa

SEQ ID NO: 1648 - RNA, 16 nt, Artificial Sequence
  Description of Artificial Sequence: Synthetic Antisense oligonucleotide
  misc_feature (1)..(1): bicyclic nucleic acid (BNA)
cgguaaguucugucca

SEQ ID NO: 1649 - RNA, 15 nt, Artificial Sequence
  Description of Artificial Sequence: Synthetic Antisense oligonucleotide
  misc_feature (1)..(1): bicyclic nucleic acid (BNA)
cgguaaguucugucc

SEQ ID NO: 1650 - RNA, 14 nt, Artificial Sequence
  Description of Artificial Sequence: Synthetic Antisense oligonucleotide
  misc_feature (1)..(1): bicyclic nucleic acid (BNA)
cgguaaguucuguc

SEQ ID NO: 1651 - RNA, 13 nt, Artificial Sequence
  Description of Artificial Sequence: Synthetic Antisense oligonucleotide
  misc_feature (1)..(1): bicyclic nucleic acid (BNA)
cgguaaguucugu

SEQ ID NO: 1652 - RNA, 12 nt, Artificial Sequence
  Description of Artificial Sequence: Synthetic Antisense oligonucleotide
  misc_feature (1)..(1): bicyclic nucleic acid (BNA)
cgguaaguucug

SEQ ID NO: 1653 - RNA, 11 nt, Artificial Sequence
  Description of Artificial Sequence: Synthetic Antisense oligonucleotide
  misc_feature (1)..(1): bicyclic nucleic acid (BNA)
cgguaaguucu

SEQ ID NO: 1654 - RNA, 10 nt, Artificial Sequence
  Description of Artificial Sequence: Synthetic Antisense oligonucleotide
  misc_feature (1)..(1): bicyclic nucleic acid (BNA)
cgguaaguuc

SEQ ID NO: 1655 - RNA, 9 nt, Artificial Sequence
  Description of Artificial Sequence: Synthetic Antisense oligonucleotide
  misc_feature (1)..(1): bicyclic nucleic acid (BNA)
cgguaaguu

SEQ ID NO: 1656 - RNA, 8 nt, Artificial Sequence
  Description of Artificial Sequence: Synthetic Antisense oligonucleotide
  misc_feature (1)..(1): bicyclic nucleic acid (BNA)
cgguaagu

SEQ ID NO: 1657 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcgguaaguucuguccaagc

SEQ ID NO: 1658 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcgguaaguucuguccaag

SEQ ID NO: 1659 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcgguaaguucuguccaa

SEQ ID NO: 1660 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcgguaaguucugucca

SEQ ID NO: 1661 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcgguaaguucugucc

SEQ ID NO: 1662 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcgguaaguucuguc

SEQ ID NO: 1663 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcgguaaguucugu

SEQ ID NO: 1664 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcgguaaguucug

SEQ ID NO: 1665 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcgguaaguucu

SEQ ID NO: 1666 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcgguaaguuc

SEQ ID NO: 1667 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcgguaaguu

SEQ ID NO: 1668 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcgguaagu

SEQ ID NO: 1669 - RNA, 20 nt, Artificial Sequence
  Description of Artificial Sequence: Synthetic Antisense oligonucleotide
  misc_feature (1)..(1): bicyclic nucleic acid (BNA)
gucgguaaguucuguccaag

SEQ ID NO: 1670 - RNA, 19 nt, Artificial Sequence
  Description of Artificial Sequence: Synthetic Antisense oligonucleotide
  misc_feature (1)..(1): bicyclic nucleic acid (BNA)
gucgguaaguucuguccaa

SEQ ID NO: 1671 - RNA, 18 nt, Artificial Sequence
  Description of Artificial Sequence: Synthetic Antisense oligonucleotide
  misc_feature (1)..(1): bicyclic nucleic acid (BNA)
gucgguaaguucugucca

SEQ ID NO: 1672 - RNA, 17 nt, Artificial Sequence
  Description of Artificial Sequence: Synthetic Antisense oligonucleotide
  misc_feature (1)..(1): bicyclic nucleic acid (BNA)
gucgguaaguucugucc

SEQ ID NO: 1673 - RNA, 16 nt, Artificial Sequence
  Description of Artificial Sequence: Synthetic Antisense oligonucleotide
  misc_feature (1)..(1): bicyclic nucleic acid (BNA)
gucgguaaguucuguc

SEQ ID NO: 1674 - RNA, 15 nt, Artificial Sequence
  Description of Artificial Sequence: Synthetic Antisense oligonucleotide
  misc_feature (1)..(1): bicyclic nucleic acid (BNA)
gucgguaaguucugu

SEQ ID NO: 1675 - RNA, 14 nt, Artificial Sequence
  Description of Artificial Sequence: Synthetic Antisense oligonucleotide
  misc_feature (1)..(1): bicyclic nucleic acid (BNA)
gucgguaaguucug

SEQ ID NO: 1676 - RNA, 13 nt, Artificial Sequence
  Description of Artificial Sequence: Synthetic Antisense oligonucleotide
  misc_feature (1)..(1): bicyclic nucleic acid (BNA)
gucgguaaguucu

SEQ ID NO: 1677 - RNA, 12 nt, Artificial Sequence
  Description of Artificial Sequence: Synthetic Antisense oligonucleotide
  misc_feature (1)..(1): bicyclic nucleic acid (BNA)
gucgguaaguuc

SEQ ID NO: 1678 - RNA, 11 nt, Artificial Sequence
  Description of Artificial Sequence: Synthetic Antisense oligonucleotide
  misc_feature (1)..(1): bicyclic nucleic acid (BNA)
gucgguaaguu

SEQ ID NO: 1679 - RNA, 10 nt, Artificial Sequence
  Description of Artificial Sequence: Synthetic Antisense oligonucleotide
  misc_feature (1)..(1): bicyclic nucleic acid (BNA)
gucgguaagu

SEQ ID NO: 1680 - RNA, 20 nt, Artificial Sequence
  Description of Artificial Sequence: Synthetic Antisense oligonucleotide
  misc_feature (1)..(1): bicyclic nucleic acid (BNA)
agucgguaaguucuguccaa

SEQ ID NO: 1681 - RNA, 19 nt, Artificial Sequence
  Description of Artificial Sequence: Synthetic Antisense oligonucleotide
  misc_feature (1)..(1): bicyclic nucleic acid (BNA)
agucgguaaguucugucca

SEQ ID NO: 1682 - RNA, 17 nt, Artificial Sequence
  Description of Artificial Sequence: Synthetic Antisense oligonucleotide
  misc_feature (1)..(1): bicyclic nucleic acid (BNA)
agucgguaaguucuguc

SEQ ID NO: 1683 - RNA, 16 nt, Artificial Sequence
  Description of Artificial Sequence: Synthetic Antisense oligonucleotide
  misc_feature (1)..(1): bicyclic nucleic acid (BNA)
agucgguaaguucugu

SEQ ID NO: 1684 - RNA, 15 nt, Artificial Sequence
  Description of Artificial Sequence: Synthetic Antisense oligonucleotide
  misc_feature (1)..(1): bicyclic nucleic acid (BNA)
agucgguaaguucug

SEQ ID NO: 1685 - RNA, 14 nt, Artificial Sequence
  Description of Artificial Sequence: Synthetic Antisense oligonucleotide
  misc_feature (1)..(1): bicyclic nucleic acid (BNA)
agucgguaaguucu

SEQ ID NO: 1686 - RNA, 13 nt, Artificial Sequence
  Description of Artificial Sequence: Synthetic Antisense oligonucleotide
  misc_feature (1)..(1): bicyclic nucleic acid (BNA)
agucgguaaguuc

SEQ ID NO: 1687 - RNA, 12 nt, Artificial Sequence
  Description of Artificial Sequence: Synthetic Antisense oligonucleotide
  misc_feature (1)..(1): bicyclic nucleic acid (BNA)
agucgguaaguu

SEQ ID NO: 1688 - RNA, 11 nt, Artificial Sequence
  Description of Artificial Sequence: Synthetic Antisense oligonucleotide
  misc_feature (1)..(1): bicyclic nucleic acid (BNA)
agucgguaagu

SEQ ID NO: 1689 - RNA, 20 nt, Artificial Sequence
  Description of Artificial Sequence: Synthetic Antisense oligonucleotide
  misc_feature (1)..(1): bicyclic nucleic acid (BNA)
cagucgguaaguucugucca

SEQ ID NO: 1690 - RNA, 19 nt, Artificial Sequence
  Description of Artificial Sequence: Synthetic Antisense oligonucleotide
  misc_feature (1)..(1): bicyclic nucleic acid (BNA)
cagucgguaaguucugucc

SEQ ID NO: 1691 - RNA, 18 nt, Artificial Sequence
  Description of Artificial Sequence: Synthetic Antisense oligonucleotide
  misc_feature (1)..(1): bicyclic nucleic acid (BNA)
cagucgguaaguucuguc

SEQ ID NO: 1692 - RNA, 17 nt, Artificial Sequence
  Description of Artificial Sequence: Synthetic Antisense oligonucleotide
  misc_feature (1)..(1): bicyclic nucleic acid (BNA)
cagucgguaaguucugu

SEQ ID NO: 1693 - RNA, 16 nt, Artificial Sequence
  Description of Artificial Sequence: Synthetic Antisense oligonucleotide
  misc_feature (1)..(1): bicyclic nucleic acid (BNA)
cagucgguaaguucug

SEQ ID NO: 1694 - RNA, 15 nt, Artificial Sequence
  Description of Artificial Sequence: Synthetic Antisense oligonucleotide
  misc_feature (1)..(1): bicyclic nucleic acid (BNA)
cagucgguaaguucu

SEQ ID NO: 1695 - RNA, 14 nt, Artificial Sequence
  Description of Artificial Sequence: Synthetic Antisense oligonucleotide
  misc_feature (1)..(1): bicyclic nucleic acid (BNA)
cagucgguaaguuc

SEQ ID NO: 1696 - RNA, 13 nt, Artificial Sequence
  Description of Artificial Sequence: Synthetic Antisense oligonucleotide
  misc_feature (1)..(1): bicyclic nucleic acid (BNA)
cagucgguaaguu

SEQ ID NO: 1697 - RNA, 12 nt, Artificial Sequence
  Description of Artificial Sequence: Synthetic Antisense oligonucleotide
  misc_feature (1)..(1): bicyclic nucleic acid (BNA)
cagucgguaagu

SEQ ID NO: 1698 - RNA, 20 nt, Artificial Sequence
  Description of Artificial Sequence: Synthetic Antisense oligonucleotide
  misc_feature (1)..(1): bicyclic nucleic acid (BNA)
ccagucgguaaguucugucc

SEQ ID NO: 1699 - RNA, 19 nt, Artificial Sequence
  Description of Artificial Sequence: Synthetic Antisense oligonucleotide
  misc_feature (1)..(1): bicyclic nucleic acid (BNA)
ccagucgguaaguucuguc

SEQ ID NO: 1700 - RNA, 18 nt, Artificial Sequence
  Description of Artificial Sequence: Synthetic Antisense oligonucleotide
  misc_feature (1)..(1): bicyclic nucleic acid (BNA)
ccagucgguaaguucugu

SEQ ID NO: 1701 - RNA, 17 nt, Artificial Sequence
  Description of Artificial Sequence: Synthetic Antisense oligonucleotide
  misc_feature (1)..(1): bicyclic nucleic acid (BNA)
ccagucgguaaguucug

SEQ ID NO: 1702 - RNA, 16 nt, Artificial Sequence
  Description of Artificial Sequence: Synthetic Antisense oligonucleotide
  misc_feature (1)..(1): bicyclic nucleic acid (BNA)
ccagucgguaaguucu

SEQ ID NO: 1703 - RNA, 15 nt, Artificial Sequence
  Description of Artificial Sequence: Synthetic Antisense oligonucleotide
  misc_feature (1)..(1): bicyclic nucleic acid (BNA)
ccagucgguaaguuc

SEQ ID NO: 1704 - RNA, 14 nt, Artificial Sequence
  Description of Artificial Sequence: Synthetic Antisense oligonucleotide
  misc_feature (1)..(1): bicyclic nucleic acid (BNA)
ccagucgguaaguu

SEQ ID NO: 1705 - RNA, 13 nt, Artificial Sequence
  Description of Artificial Sequence: Synthetic Antisense oligonucleotide
  misc_feature (1)..(1): bicyclic nucleic acid (BNA)
ccagucgguaagu

SEQ ID NO: 1706 - RNA, 20 nt, Artificial Sequence
  Description of Artificial Sequence: Synthetic Antisense oligonucleotide
  misc_feature (1)..(1): bicyclic nucleic acid (BNA)
gccagucgguaaguucuguc

SEQ ID NO: 1707 - RNA, 19 nt, Artificial Sequence
  Description of Artificial Sequence: Synthetic Antisense oligonucleotide
  misc_feature (1)..(1): bicyclic nucleic acid (BNA)
gccagucgguaaguucugu

SEQ ID NO: 1708 - RNA, 18 nt, Artificial Sequence
  Description of Artificial Sequence: Synthetic Antisense oligonucleotide
  misc_feature (1)..(1): bicyclic nucleic acid (BNA)
gccagucgguaaguucug

SEQ ID NO: 1709 - RNA, 17 nt, Artificial Sequence
  Description of Artificial Sequence: Synthetic Antisense oligonucleotide
  misc_feature (1)..(1): bicyclic nucleic acid (BNA)
gccagucgguaaguucu

SEQ ID NO: 1710 - RNA, 16 nt, Artificial Sequence
  Description of Artificial Sequence: Synthetic Antisense oligonucleotide
  misc_feature (1)..(1): bicyclic nucleic acid (BNA)
gccagucgguaaguuc

SEQ ID NO: 1711 - RNA, 15 nt, Artificial Sequence
  Description of Artificial Sequence: Synthetic Antisense oligonucleotide
  misc_feature (1)..(1): bicyclic nucleic acid (BNA)
gccagucgguaaguu

SEQ ID NO: 1712 - RNA, 14 nt, Artificial Sequence
  Description of Artificial Sequence: Synthetic Antisense oligonucleotide
  misc_feature (1)..(1): bicyclic nucleic acid (BNA)
gccagucgguaagu

SEQ ID NO: 1713 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcaaggaagauggcauuucu

SEQ ID NO: 1714 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcaaggaagauggcauuucuag

SEQ ID NO: 1715 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcaaggaagauggcau

SEQ ID NO: 1716 - RNA, 15 nt, Artificial Sequence
  Description of Artificial Sequence: Synthetic Antisense oligonucleotide
  misc_feature (1)..(1): bicyclic nucleic acid (BNA)
gaagauggcauuucu

SEQ ID NO: 1717 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcaaggaagauggcauuucua

SEQ ID NO: 1718 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcaaggaagauggcauuuc

SEQ ID NO: 1719 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcaaggaagauggcauuu

SEQ ID NO: 1720 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcaaggaagauggcauu

SEQ ID NO: 1721 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcaaggaagauggca

SEQ ID NO: 1722 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcaaggaagauggc

SEQ ID NO: 1723 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcaaggaagaugg

SEQ ID NO: 1724 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcaaggaagaug

SEQ ID NO: 1725 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcaaggaagau

SEQ ID NO: 1726 - DNA, 10 bp, Artificial Sequence
  Description of Artificial Sequence: Synthetic Antisense oligonucleotide
  misc_feature (1)..(1): bicyclic nucleic acid (BNA)
tcaaggaaga

SEQ ID NO: 1727 - DNA, 9 bp, Artificial Sequence
  Description of Artificial Sequence: Synthetic Antisense oligonucleotide
  misc_feature (1)..(1): bicyclic nucleic acid (BNA)
tcaaggaag

SEQ ID NO: 1728 - RNA, 21 nt, Artificial Sequence
  Description of Artificial Sequence: Synthetic Antisense oligonucleotide
  misc_feature (1)..(1): bicyclic nucleic acid (BNA)
caaggaagauggcauuucuag

SEQ ID NO: 1729 - RNA, 20 nt, Artificial Sequence
  Description of Artificial Sequence: Synthetic Antisense oligonucleotide
  misc_feature (1)..(1): bicyclic nucleic acid (BNA)
caaggaagauggcauuucua

SEQ ID NO: 1730 - RNA, 19 nt, Artificial Sequence
  Description of Artificial Sequence: Synthetic Antisense oligonucleotide
  misc_feature (1)..(1): bicyclic nucleic acid (BNA)
caaggaagauggcauuucu

SEQ ID NO: 1731 - RNA, 18 nt, Artificial Sequence
  Description of Artificial Sequence: Synthetic Antisense oligonucleotide
  misc_feature (1)..(1): bicyclic nucleic acid (BNA)
caaggaagauggcauuuc

SEQ ID NO: 1732 - RNA, 17 nt, Artificial Sequence
  Description of Artificial Sequence: Synthetic Antisense oligonucleotide
  misc_feature (1)..(1): bicyclic nucleic acid (BNA)
caaggaagauggcauuu

SEQ ID NO: 1733 - RNA, 16 nt, Artificial Sequence
  Description of Artificial Sequence: Synthetic Antisense oligonucleotide
  misc_feature (1)..(1): bicyclic nucleic acid (BNA)
caaggaagauggcauu

SEQ ID NO: 1734 - RNA, 15 nt, Artificial Sequence
  Description of Artificial Sequence: Synthetic Antisense oligonucleotide
  misc_feature (1)..(1): bicyclic nucleic acid (BNA)
caaggaagauggcau

SEQ ID NO: 1735 - RNA, 14 nt, Artificial Sequence
  Description of Artificial Sequence: Synthetic Antisense oligonucleotide
  misc_feature (1)..(1): bicyclic nucleic acid (BNA)
caaggaagauggca

SEQ ID NO: 1736 - RNA, 13 nt, Artificial Sequence
  Description of Artificial Sequence: Synthetic Antisense oligonucleotide
  misc_feature (1)..(1): bicyclic nucleic acid (BNA)
caaggaagauggc

SEQ ID NO: 1737 - RNA, 12 nt, Artificial Sequence
  Description of Artificial Sequence: Synthetic Antisense oligonucleotide
  misc_feature (1)..(1): bicyclic nucleic acid (BNA)
caaggaagaugg

SEQ ID NO: 1738 - RNA, 11 nt, Artificial Sequence
  Description of Artificial Sequence: Synthetic Antisense oligonucleotide
  misc_feature (1)..(1): bicyclic nucleic acid (BNA)
caaggaagaug

SEQ ID NO: 1739 - RNA, 10 nt, Artificial Sequence
  Description of Artificial Sequence: Synthetic Antisense oligonucleotide
  misc_feature (1)..(1): bicyclic nucleic acid (BNA)
caaggaagau

SEQ ID NO: 1740 - RNA, 9 nt, Artificial Sequence
  Description of Artificial Sequence: Synthetic Antisense oligonucleotide
  misc_feature (1)..(1): bicyclic nucleic acid (BNA)
caaggaaga

SEQ ID NO: 1741 - RNA, 8 nt, Artificial Sequence
  Description of Artificial Sequence: Synthetic Antisense oligonucleotide
  misc_feature (1)..(1): bicyclic nucleic acid (BNA)
caaggaag

SEQ ID NO: 1742 - RNA, 20 nt, Artificial Sequence
  Description of Artificial Sequence: Synthetic Antisense oligonucleotide
  misc_feature (1)..(1): bicyclic nucleic acid (BNA)
aaggaagauggcauuucuag

SEQ ID NO: 1743 - RNA, 19 nt, Artificial Sequence
  Description of Artificial Sequence: Synthetic Antisense oligonucleotide
  misc_feature (1)..(1): bicyclic nucleic acid (BNA)
aaggaagauggcauuucua

SEQ ID NO: 1744 - RNA, 18 nt, Artificial Sequence
  Description of Artificial Sequence: Synthetic Antisense oligonucleotide
  misc_feature (1)..(1): bicyclic nucleic acid (BNA)
aaggaagauggcauuucu

SEQ ID NO: 1745 - RNA, 17 nt, Artificial Sequence
  Description of Artificial Sequence: Synthetic Antisense oligonucleotide
  misc_feature (1)..(1): bicyclic nucleic acid (BNA)
aaggaagauggcauuuc

SEQ ID NO: 1746 - RNA, 16 nt, Artificial Sequence
  Description of Artificial Sequence: Synthetic Antisense oligonucleotide
  misc_feature (1)..(1): bicyclic nucleic acid (BNA)
aaggaagauggcauuu

SEQ ID NO: 1747 - RNA, 15 nt, Artificial Sequence
  Description of Artificial Sequence: Synthetic Antisense oligonucleotide
  misc_feature (1)..(1): bicyclic nucleic acid (BNA)
aaggaagauggcauu

SEQ ID NO: 1748 - RNA, 14 nt, Artificial Sequence
  Description of Artificial Sequence: Synthetic Antisense oligonucleotide
  misc_feature (1)..(1): bicyclic nucleic acid (BNA)
aaggaagauggcau

SEQ ID NO: 1749 - RNA, 13 nt, Artificial Sequence
  Description of Artificial Sequence: Synthetic Antisense oligonucleotide
  misc_feature (1)..(1): bicyclic nucleic acid (BNA)
aaggaagauggca

SEQ ID NO: 1750 - RNA, 12 nt, Artificial Sequence
  Description of Artificial Sequence: Synthetic Antisense oligonucleotide
  misc_feature (1)..(1): bicyclic nucleic acid (BNA)
aaggaagauggc

SEQ ID NO: 1751 - RNA, 11 nt, Artificial Sequence
  Description of Artificial Sequence: Synthetic Antisense oligonucleotide
  misc_feature (1)..(1): bicyclic nucleic acid (BNA)
aaggaagaugg

SEQ ID NO: 1752 - RNA, 10 nt, Artificial Sequence
  Description of Artificial Sequence: Synthetic Antisense oligonucleotide
  misc_feature (1)..(1): bicyclic nucleic acid (BNA)
aaggaagaug

SEQ ID NO: 1753 - RNA, 9 nt, Artificial Sequence
  Description of Artificial Sequence: Synthetic Antisense oligonucleotide
  misc_feature (1)..(1): bicyclic nucleic acid (BNA)
aaggaagau

SEQ ID NO: 1754 - RNA, 8 nt, Artificial Sequence
  Description of Artificial Sequence: Synthetic Antisense oligonucleotide
  misc_feature (1)..(1): bicyclic nucleic acid (BNA)
aaggaaga

SEQ ID NO: 1755 - RNA, 19 nt, Artificial Sequence
  Description of Artificial Sequence: Synthetic Antisense oligonucleotide
  misc_feature (1)..(1): bicyclic nucleic acid (BNA)
aggaagauggcauuucuag

SEQ ID NO: 1756 - RNA, 18 nt, Artificial Sequence
  Description of Artificial Sequence: Synthetic Antisense oligonucleotide
  misc_feature (1)..(1): bicyclic nucleic acid (BNA)
aggaagauggcauuucua

SEQ ID NO: 1757 - RNA, 17 nt, Artificial Sequence
  Description of Artificial Sequence: Synthetic Antisense oligonucleotide
  misc_feature (1)..(1): bicyclic nucleic acid (BNA)
aggaagauggcauuucu

SEQ ID NO: 1758 - RNA, 16 nt, Artificial Sequence
  Description of Artificial Sequence: Synthetic Antisense oligonucleotide
  misc_feature (1)..(1): bicyclic nucleic acid (BNA)
aggaagauggcauuuc

SEQ ID NO: 1759 - RNA, 15 nt, Artificial Sequence
  Description of Artificial Sequence: Synthetic Antisense oligonucleotide
  misc_feature (1)..(1): bicyclic nucleic acid (BNA)
aggaagauggcauuu

SEQ ID NO: 1760 - RNA, 14 nt, Artificial Sequence
  Description of Artificial Sequence: Synthetic Antisense oligonucleotide
  misc_feature (1)..(1): bicyclic nucleic acid (BNA)
aggaagauggcauu

SEQ ID NO: 1761 - RNA, 13 nt, Artificial Sequence
  Description of Artificial Sequence: Synthetic Antisense oligonucleotide
  misc_feature (1)..(1): bicyclic nucleic acid (BNA)
aggaagauggcau

SEQ ID NO: 1762 - RNA, 12 nt, Artificial Sequence
  Description of Artificial Sequence: Synthetic Antisense oligonucleotide
  misc_feature (1)..(1): bicyclic nucleic acid (BNA)
aggaagauggca

SEQ ID NO: 1763 - RNA, 10 nt, Artificial Sequence
  Description of Artificial Sequence: Synthetic Antisense oligonucleotide
  misc_feature (1)..(1): bicyclic nucleic acid (BNA)
aggaagaugg

SEQ ID NO: 1764 - RNA, 9 nt, Artificial Sequence
  Description of Artificial Sequence: Synthetic Antisense oligonucleotide
  misc_feature (1)..(1): bicyclic nucleic acid (BNA)
aggaagaug

SEQ ID NO: 1765 - RNA, 8 nt, Artificial Sequence
  Description of Artificial Sequence: Synthetic Antisense oligonucleotide
  misc_feature (1)..(1): bicyclic nucleic acid (BNA)
aggaagau

SEQ ID NO: 1766 - RNA, 18 nt, Artificial Sequence
  Description of Artificial Sequence: Synthetic Antisense oligonucleotide
  misc_feature (1)..(1): bicyclic nucleic acid (BNA)
ggaagauggcauuucuag

SEQ ID NO: 1767 - RNA, 17 nt, Artificial Sequence
  Description of Artificial Sequence: Synthetic Antisense oligonucleotide
  misc_feature (1)..(1): bicyclic nucleic acid (BNA)
ggaagauggcauuucua

SEQ ID NO: 1768 - RNA, 16 nt, Artificial Sequence
  Description of Artificial Sequence: Synthetic Antisense oligonucleotide
  misc_feature (1)..(1): bicyclic nucleic acid (BNA)
ggaagauggcauuucu

SEQ ID NO: 1769 - RNA, 15 nt, Artificial Sequence
  Description of Artificial Sequence: Synthetic Antisense oligonucleotide
  misc_feature (1)..(1): bicyclic nucleic acid (BNA)
ggaagauggcauuuc

SEQ ID NO: 1770 - RNA, 14 nt, Artificial Sequence
  Description of Artificial Sequence: Synthetic Antisense oligonucleotide
  misc_feature (1)..(1): bicyclic nucleic acid (BNA)
ggaagauggcauuu

SEQ ID NO: 1771 - RNA, 13 nt, Artificial Sequence
  Description of Artificial Sequence: Synthetic Antisense oligonucleotide
  misc_feature (1)..(1): bicyclic nucleic acid (BNA)
ggaagauggcauu

SEQ ID NO: 1772 - RNA, 12 nt, Artificial Sequence
  Description of Artificial Sequence: Synthetic Antisense oligonucleotide
  misc_feature (1)..(1): bicyclic nucleic acid (BNA)
ggaagauggcau

SEQ ID NO: 1773 - RNA, 11 nt, Artificial Sequence
  Description of Artificial Sequence: Synthetic Antisense oligonucleotide
  misc_feature (1)..(1): bicyclic nucleic acid (BNA)
ggaagauggca

SEQ ID NO: 1774 - RNA, 10 nt, Artificial Sequence
  Description of Artificial Sequence: Synthetic Antisense oligonucleotide
  misc_feature (1)..(1): bicyclic nucleic acid (BNA)
ggaagauggc

SEQ ID NO: 1775 - RNA, 8 nt, Artificial Sequence
  Description of Artificial Sequence: Synthetic Antisense oligonucleotide
  misc_feature (1)..(1): bicyclic nucleic acid (BNA)
ggaagaug

SEQ ID NO: 1776 - RNA, 17 nt, Artificial Sequence
  Description of Artificial Sequence: Synthetic Antisense oligonucleotide
  misc_feature (1)..(1): bicyclic nucleic acid (BNA)
gaagauggcauuucuag

SEQ ID NO: 1777 - RNA, 16 nt, Artificial Sequence
  Description of Artificial Sequence: Synthetic Antisense oligonucleotide
  misc_feature (1)..(1): bicyclic nucleic acid (BNA)
gaagauggcauuucua

SEQ ID NO: 1778 - RNA, 14 nt, Artificial Sequence
  Description of Artificial Sequence: Synthetic Antisense oligonucleotide
  misc_feature (1)..(1): bicyclic nucleic acid (BNA)
gaagauggcauuuc

SEQ ID NO: 1779 - RNA, 13 nt, Artificial Sequence
  Description of Artificial Sequence: Synthetic Antisense oligonucleotide
  misc_feature (1)..(1): bicyclic nucleic acid (BNA)
gaagauggcauuu

SEQ ID NO: 1780 - RNA, 12 nt, Artificial Sequence
  Description of Artificial Sequence: Synthetic Antisense oligonucleotide
  misc_feature (1)..(1): bicyclic nucleic acid (BNA)
gaagauggcauu

SEQ ID NO: 1781 - RNA, 11 nt, Artificial Sequence
  Description of Artificial Sequence: Synthetic Antisense oligonucleotide
  misc_feature (1)..(1): bicyclic nucleic acid (BNA)
gaagauggcau

SEQ ID NO: 1782 - RNA, 10 nt, Artificial Sequence
  Description of Artificial Sequence: Synthetic Antisense oligonucleotide
  misc_feature (1)..(1): bicyclic nucleic acid (BNA)
gaagauggca

SEQ ID NO: 1783 - RNA, 9 nt, Artificial Sequence
  Description of Artificial Sequence: Synthetic Antisense oligonucleotide
  misc_feature (1)..(1): bicyclic nucleic acid (BNA)
gaagauggc

SEQ ID NO: 1784 - RNA, 8 nt, Artificial Sequence
  Description of Artificial Sequence: Synthetic Antisense oligonucleotide
  misc_feature (1)..(1): bicyclic nucleic acid (BNA)
gaagaugg

SEQ ID NO: 1785 - RNA, 16 nt, Artificial Sequence
  Description of Artificial Sequence: Synthetic Antisense oligonucleotide
  misc_feature (1)..(1): bicyclic nucleic acid (BNA)
aagauggcauuucuag

SEQ ID NO: 1786 - RNA, 15 nt, Artificial Sequence
  Description of Artificial Sequence: Synthetic Antisense oligonucleotide
  misc_feature (1)..(1): bicyclic nucleic acid (BNA)
aagauggcauuucua

SEQ ID NO: 1787 - RNA, 14 nt, Artificial Sequence
  Description of Artificial Sequence: Synthetic Antisense oligonucleotide
  misc_feature (1)..(1): bicyclic nucleic acid (BNA)
aagauggcauuucu

SEQ ID NO: 1788 - RNA, 13 nt, Artificial Sequence
  Description of Artificial Sequence: Synthetic Antisense oligonucleotide
  misc_feature (1)..(1): bicyclic nucleic acid (BNA)
aagauggcauuuc

SEQ ID NO: 1789 - RNA, 12 nt, Artificial Sequence
  Description of Artificial Sequence: Synthetic Antisense oligonucleotide
  misc_feature (1)..(1): bicyclic nucleic acid (BNA)
aagauggcauuu

SEQ ID NO: 1790 - RNA, 11 nt, Artificial Sequence
  Description of Artificial Sequence: Synthetic Antisense oligonucleotide
  misc_feature (1)..(1): bicyclic nucleic acid (BNA)
aagauggcauu

SEQ ID NO: 1791 - RNA, 10 nt, Artificial Sequence
  Description of Artificial Sequence: Synthetic Antisense oligonucleotide
  misc_feature (1)..(1): bicyclic nucleic acid (BNA)
aagauggcau

SEQ ID NO: 1792 - RNA, 9 nt, Artificial Sequence
  Description of Artificial Sequence: Synthetic Antisense oligonucleotide
  misc_feature (1)..(1): bicyclic nucleic acid (BNA)
aagauggca

SEQ ID NO: 1793 - RNA, 8 nt, Artificial Sequence
  Description of Artificial Sequence: Synthetic Antisense oligonucleotide
  misc_feature (1)..(1): bicyclic nucleic acid (BNA)
aagauggc

SEQ ID NO: 1794 - RNA, 15 nt, Artificial Sequence
  Description of Artificial Sequence: Synthetic Antisense oligonucleotide
  misc_feature (1)..(1): bicyclic nucleic acid (BNA)
agauggcauuucuag

SEQ ID NO: 1795 - RNA, 14 nt, Artificial Sequence
  Description of Artificial Sequence: Synthetic Antisense oligonucleotide
  misc_feature (1)..(1): bicyclic nucleic acid (BNA)
agauggcauuucua

SEQ ID NO: 1796 - RNA, 13 nt, Artificial Sequence
  Description of Artificial Sequence: Synthetic Antisense oligonucleotide
  misc_feature (1)..(1): bicyclic nucleic acid (BNA)
agauggcauuucu

SEQ ID NO: 1797 - RNA, 12 nt, Artificial Sequence
  Description of Artificial Sequence: Synthetic Antisense oligonucleotide
  misc_feature (1)..(1): bicyclic nucleic acid (BNA)
agauggcauuuc

SEQ ID NO: 1798 - RNA, 11 nt, Artificial Sequence
  Description of Artificial Sequence: Synthetic Antisense oligonucleotide
  misc_feature (1)..(1): bicyclic nucleic acid (BNA)
agauggcauuu

SEQ ID NO: 1799 - RNA, 10 nt, Artificial Sequence
  Description of Artificial Sequence: Synthetic Antisense oligonucleotide
  misc_feature (1)..(1): bicyclic nucleic acid (BNA)
agauggcauu

SEQ ID NO: 1800 - RNA, 9 nt, Artificial Sequence
  Description of Artificial Sequence: Synthetic Antisense oligonucleotide
  misc_feature (1)..(1): bicyclic nucleic acid (BNA)
agauggcau

SEQ ID NO: 1801 - RNA, 8 nt, Artificial Sequence
  Description of Artificial Sequence: Synthetic Antisense oligonucleotide
  misc_feature (1)..(1): bicyclic nucleic acid (BNA)
agauggca

SEQ ID NO: 1802 - RNA, 30 nt, Artificial Sequence; identical to SEQ ID NO: 287
  Description of Artificial Sequence: Synthetic Antisense oligonucleotide
  misc_feature (1)..(1): bicyclic nucleic acid (BNA)

SEQ ID NO: 1803 - RNA, 29 nt, Artificial Sequence
  Description of Artificial Sequence: Synthetic Antisense oligonucleotide
  misc_feature (1)..(1): bicyclic nucleic acid (BNA)
cuccaacaucaaggaagauggcauuucua

SEQ ID NO: 1804 - RNA, 28 nt, Artificial Sequence
  Description of Artificial Sequence: Synthetic Antisense oligonucleotide
  misc_feature (1)..(1): bicyclic nucleic acid (BNA)
cuccaacaucaaggaagauggcauuucu

SEQ ID NO: 1805 - RNA, 27 nt, Artificial Sequence
  Description of Artificial Sequence: Synthetic Antisense oligonucleotide
  misc_feature (1)..(1): bicyclic nucleic acid (BNA)
cuccaacaucaaggaagauggcauuuc

SEQ ID NO: 1806 - RNA, 26 nt, Artificial Sequence
  Description of Artificial Sequence: Synthetic Antisense oligonucleotide
  misc_feature (1)..(1): bicyclic nucleic acid (BNA)
cuccaacaucaaggaagauggcauuu

SEQ ID NO: 1807 - RNA, 25 nt, Artificial Sequence
  Description of Artificial Sequence: Synthetic Antisense oligonucleotide
  misc_feature (1)..(1): bicyclic nucleic acid (BNA)
cuccaacaucaaggaagauggcauu

SEQ ID NO: 1808 - RNA, 24 nt, Artificial Sequence
  Description of Artificial Sequence: Synthetic Antisense oligonucleotide
  misc_feature (1)..(1): bicyclic nucleic acid (BNA)
cuccaacaucaaggaagauggcau

SEQ ID NO: 1809 - RNA, 23 nt, Artificial Sequence
  Description of Artificial Sequence: Synthetic Antisense oligonucleotide
  misc_feature (1)..(1): bicyclic nucleic acid (BNA)
cuccaacaucaaggaagauggca

SEQ ID NO: 1810 - RNA, 22 nt, Artificial Sequence
  Description of Artificial Sequence: Synthetic Antisense oligonucleotide
  misc_feature (1)..(1): bicyclic nucleic acid (BNA)
cuccaacaucaaggaagauggc

SEQ ID NO: 1811 - RNA, 21 nt, Artificial Sequence
  Description of Artificial Sequence: Synthetic Antisense oligonucleotide
  misc_feature (1)..(1): bicyclic nucleic acid (BNA)
cuccaacaucaaggaagaugg

SEQ ID NO: 1812 - RNA, 20 nt, Artificial Sequence
  Description of Artificial Sequence: Synthetic Antisense oligonucleotide
  misc_feature (1)..(1): bicyclic nucleic acid (BNA)
cuccaacaucaaggaagaug

SEQ ID NO: 1813 - RNA, 19 nt, Artificial Sequence
  Description of Artificial Sequence: Synthetic Antisense oligonucleotide
  misc_feature (1)..(1): bicyclic nucleic acid (BNA)
cuccaacaucaaggaagau

SEQ ID NO: 1814 - RNA, 18 nt, Artificial Sequence
  Description of Artificial Sequence: Synthetic Antisense oligonucleotide
  misc_feature (1)..(1): bicyclic nucleic acid (BNA)
cuccaacaucaaggaaga

SEQ ID NO: 1815 - RNA, 17 nt, Artificial Sequence
  Description of Artificial Sequence: Synthetic Antisense oligonucleotide
  misc_feature (1)..(1): bicyclic nucleic acid (BNA)
cuccaacaucaaggaag

SEQ ID NO: 1816 - DNA, 29 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tccaacaucaaggaagauggcauuucuag

SEQ ID NO: 1817 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tccaacaucaaggaagauggcauuucua

SEQ ID NO: 1818 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tccaacaucaaggaagauggcauuucu

SEQ ID NO: 1819 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tccaacaucaaggaagauggcauuuc

SEQ ID NO: 1820 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tccaacaucaaggaagauggcauuu

SEQ ID NO: 1821 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tccaacaucaaggaagauggcauu

SEQ ID NO: 1822 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tccaacaucaaggaagauggcau

SEQ ID NO: 1823 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tccaacaucaaggaagauggca

SEQ ID NO: 1824 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tccaacaucaaggaagauggc

SEQ ID NO: 1825 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tccaacaucaaggaagaugg

SEQ ID NO: 1826 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tccaacaucaaggaagaug

SEQ ID NO: 1827 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tccaacaucaaggaagau

SEQ ID NO: 1828 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tccaacaucaaggaaga

SEQ ID NO: 1829 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tccaacaucaaggaag

SEQ ID NO: 1830 - RNA, 28 nt, Artificial Sequence
  Description of Artificial Sequence: Synthetic Antisense oligonucleotide
  misc_feature (1)..(1): bicyclic nucleic acid (BNA)
ccaacaucaaggaagauggcauuucuag

SEQ ID NO: 1831 - RNA, 27 nt, Artificial Sequence
  Description of Artificial Sequence: Synthetic Antisense oligonucleotide
  misc_feature (1)..(1): bicyclic nucleic acid (BNA)
ccaacaucaaggaagauggcauuucua

SEQ ID NO: 1832 - RNA, 26 nt, Artificial Sequence
  Description of Artificial Sequence: Synthetic Antisense oligonucleotide
  misc_feature (1)..(1): bicyclic nucleic acid (BNA)
ccaacaucaaggaagauggcauuucu

SEQ ID NO: 1833 - RNA, 25 nt, Artificial Sequence
  Description of Artificial Sequence: Synthetic Antisense oligonucleotide
  misc_feature (1)..(1): bicyclic nucleic acid (BNA)
ccaacaucaaggaagauggcauuuc

SEQ ID NO: 1834 - RNA, 24 nt, Artificial Sequence
  Description of Artificial Sequence: Synthetic Antisense oligonucleotide
  misc_feature (1)..(1): bicyclic nucleic acid (BNA)
ccaacaucaaggaagauggcauuu

SEQ ID NO: 1835 - RNA, 23 nt, Artificial Sequence
  Description of Artificial Sequence: Synthetic Antisense oligonucleotide
  misc_feature (1)..(1): bicyclic nucleic acid (BNA)
ccaacaucaaggaagauggcauu

SEQ ID NO: 1836 - RNA, 22 nt, Artificial Sequence
  Description of Artificial Sequence: Synthetic Antisense oligonucleotide
  misc_feature (1)..(1): bicyclic nucleic acid (BNA)
ccaacaucaaggaagauggcau

SEQ ID NO: 1837 - RNA, 21 nt, Artificial Sequence
  Description of Artificial Sequence: Synthetic Antisense oligonucleotide
  misc_feature (1)..(1): bicyclic nucleic acid (BNA)
ccaacaucaaggaagauggca

SEQ ID NO: 1838 - RNA, 20 nt, Artificial Sequence
  Description of Artificial Sequence: Synthetic Antisense oligonucleotide
  misc_feature (1)..(1): bicyclic nucleic acid (BNA)
ccaacaucaaggaagauggc

SEQ ID NO: 1839 - RNA, 19 nt, Artificial Sequence
  Description of Artificial Sequence: Synthetic Antisense oligonucleotide
  misc_feature (1)..(1): bicyclic nucleic acid (BNA)
ccaacaucaaggaagaugg

SEQ ID NO: 1840 - RNA, 18 nt, Artificial Sequence
  Description of Artificial Sequence: Synthetic Antisense oligonucleotide
  misc_feature (1)..(1): bicyclic nucleic acid (BNA)
ccaacaucaaggaagaug

SEQ ID NO: 1841 - RNA, 17 nt, Artificial Sequence
  Description of Artificial Sequence: Synthetic Antisense oligonucleotide
  misc_feature (1)..(1): bicyclic nucleic acid (BNA)
ccaacaucaaggaagau

SEQ ID NO: 1842 - RNA, 16 nt, Artificial Sequence
  Description of Artificial Sequence: Synthetic Antisense oligonucleotide
  misc_feature (1)..(1): bicyclic nucleic acid (BNA)
ccaacaucaaggaaga

SEQ ID NO: 1843 - RNA, 15 nt, Artificial Sequence
  Description of Artificial Sequence: Synthetic Antisense oligonucleotide
  misc_feature (1)..(1): bicyclic nucleic acid (BNA)
ccaacaucaaggaag

SEQ ID NO: 1844 - RNA, 27 nt, Artificial Sequence
  Description of Artificial Sequence: Synthetic Antisense oligonucleotide
  misc_feature (1)..(1): bicyclic nucleic acid (BNA)
caacaucaaggaagauggcauuucuag

SEQ ID NO: 1845 - RNA, 26 nt, Artificial Sequence
  Description of Artificial Sequence: Synthetic Antisense oligonucleotide
  misc_feature (1)..(1): bicyclic nucleic acid (BNA)
caacaucaaggaagauggcauuucua

SEQ ID NO: 1846 - RNA, 25 nt, Artificial Sequence
  Description of Artificial Sequence: Synthetic Antisense oligonucleotide
  misc_feature (1)..(1): bicyclic nucleic acid (BNA)
caacaucaaggaagauggcauuucu

SEQ ID NO: 1847 - RNA, 24 nt, Artificial Sequence
  Description of Artificial Sequence: Synthetic Antisense oligonucleotide
  misc_feature (1)..(1): bicyclic nucleic acid (BNA)
caacaucaaggaagauggcauuuc

SEQ ID NO: 1848 - RNA, 23 nt, Artificial Sequence
  Description of Artificial Sequence: Synthetic Antisense oligonucleotide
  misc_feature (1)..(1): bicyclic nucleic acid (BNA)
caacaucaaggaagauggcauuu

SEQ ID NO: 1849 - RNA, 22 nt, Artificial Sequence
  Description of Artificial Sequence: Synthetic Antisense oligonucleotide
  misc_feature (1)..(1): bicyclic nucleic acid (BNA)
caacaucaaggaagauggcauu

SEQ ID NO: 1850 - RNA, 21 nt, Artificial Sequence
  Description of Artificial Sequence: Synthetic Antisense oligonucleotide
  misc_feature (1)..(1): bicyclic nucleic acid (BNA)
caacaucaaggaagauggcau

SEQ ID NO: 1851 - RNA, 20 nt, Artificial Sequence
  Description of Artificial Sequence: Synthetic Antisense oligonucleotide
  misc_feature (1)..(1): bicyclic nucleic acid (BNA)
caacaucaaggaagauggca

SEQ ID NO: 1852 - RNA, 19 nt, Artificial Sequence
  Description of Artificial Sequence: Synthetic Antisense oligonucleotide
  misc_feature (1)..(1): bicyclic nucleic acid (BNA)
caacaucaaggaagauggc

SEQ ID NO: 1853 - RNA, 18 nt, Artificial Sequence
  Description of Artificial Sequence: Synthetic Antisense oligonucleotide
  misc_feature (1)..(1): bicyclic nucleic acid (BNA)
caacaucaaggaagaugg

SEQ ID NO: 1854 - RNA, 17 nt, Artificial Sequence
  Description of Artificial Sequence: Synthetic Antisense oligonucleotide
  misc_feature (1)..(1): bicyclic nucleic acid (BNA)
caacaucaaggaagaug

SEQ ID NO: 1855 - RNA, 16 nt, Artificial Sequence
  Description of Artificial Sequence: Synthetic Antisense oligonucleotide
  misc_feature (1)..(1): bicyclic nucleic acid (BNA)
caacaucaaggaagau

SEQ ID NO: 1856 - RNA, 15 nt, Artificial Sequence
  Description of Artificial Sequence: Synthetic Antisense oligonucleotide
  misc_feature (1)..(1): bicyclic nucleic acid (BNA)
caacaucaaggaaga

SEQ ID NO: 1857 - RNA, 14 nt, Artificial Sequence
  Description of Artificial Sequence: Synthetic Antisense oligonucleotide
  misc_feature (1)..(1): bicyclic nucleic acid (BNA)
caacaucaaggaag

SEQ ID NO: 1858 - RNA, 26 nt, Artificial Sequence
  Description of Artificial Sequence: Synthetic Antisense oligonucleotide
  misc_feature (1)..(1): bicyclic nucleic acid (BNA)
aacaucaaggaagauggcauuucuag

SEQ ID NO: 1859 - RNA, 25 nt, Artificial Sequence
  Description of Artificial Sequence: Synthetic Antisense oligonucleotide
  misc_feature (1)..(1): bicyclic nucleic acid (BNA)
aacaucaaggaagauggcauuucua

SEQ ID NO: 1860 - RNA, 24 nt, Artificial Sequence
  Description of Artificial Sequence: Synthetic Antisense oligonucleotide
  misc_feature (1)..(1): bicyclic nucleic acid (BNA)
aacaucaaggaagauggcauuucu

SEQ ID NO: 1861 - RNA, 23 nt, Artificial Sequence
  Description of Artificial Sequence: Synthetic Antisense oligonucleotide
  misc_feature (1)..(1): bicyclic nucleic acid (BNA)
aacaucaaggaagauggcauuuc

SEQ ID NO: 1862 - RNA, 22 nt, Artificial Sequence
  Description of Artificial Sequence: Synthetic Antisense oligonucleotide
  misc_feature (1)..(1): bicyclic nucleic acid (BNA)
aacaucaaggaagauggcauuu

SEQ ID NO: 1863 - RNA, 21 nt, Artificial Sequence
  Description of Artificial Sequence: Synthetic Antisense oligonucleotide
  misc_feature (1)..(1): bicyclic nucleic acid (BNA)
aacaucaaggaagauggcauu

SEQ ID NO: 1864 - RNA, 20 nt, Artificial Sequence
  Description of Artificial Sequence: Synthetic Antisense oligonucleotide
  misc_feature (1)..(1): bicyclic nucleic acid (BNA)
aacaucaaggaagauggcau

SEQ ID NO: 1865 - RNA, 19 nt, Artificial Sequence
  Description of Artificial Sequence: Synthetic Antisense oligonucleotide
  misc_feature (1)..(1): bicyclic nucleic acid (BNA)
aacaucaaggaagauggca

SEQ ID NO: 1866 - RNA, 18 nt, Artificial Sequence
  Description of Artificial Sequence: Synthetic Antisense oligonucleotide
  misc_feature (1)..(1): bicyclic nucleic acid (BNA)
aacaucaaggaagauggc

SEQ ID NO: 1867 - RNA, 17 nt, Artificial Sequence
  Description of Artificial Sequence: Synthetic Antisense oligonucleotide
  misc_feature (1)..(1): bicyclic nucleic acid (BNA)
aacaucaaggaagaugg

SEQ ID NO: 1868 - RNA, 16 nt, Artificial Sequence
  Description of Artificial Sequence: Synthetic Antisense oligonucleotide
  misc_feature (1)..(1): bicyclic nucleic acid (BNA)
aacaucaaggaagaug

SEQ ID NO: 1869 - RNA, 15 nt, Artificial Sequence
  Description of Artificial Sequence: Synthetic Antisense oligonucleotide
  misc_feature (1)..(1): bicyclic nucleic acid (BNA)
aacaucaaggaagau

SEQ ID NO: 1870 - RNA, 14 nt, Artificial Sequence
  Description of Artificial Sequence: Synthetic Antisense oligonucleotide
  misc_feature (1)..(1): bicyclic nucleic acid (BNA)
aacaucaaggaaga

SEQ ID NO: 1871 - RNA, 13 nt, Artificial Sequence
  Description of Artificial Sequence: Synthetic Antisense oligonucleotide
  misc_feature (1)..(1): bicyclic nucleic acid (BNA)
aacaucaaggaag

SEQ ID NO: 1872 - RNA, 25 nt, Artificial Sequence
  Description of Artificial Sequence: Synthetic Antisense oligonucleotide
  misc_feature (1)..(1): bicyclic nucleic acid (BNA)
acaucaaggaagauggcauuucuag

SEQ ID NO: 1873 - RNA, 24 nt, Artificial Sequence
  Description of Artificial Sequence: Synthetic Antisense oligonucleotide
  misc_feature (1)..(1): bicyclic nucleic acid (BNA)
acaucaaggaagauggcauuucua

SEQ ID NO: 1874 - RNA, 23 nt, Artificial Sequence
  Description of Artificial Sequence: Synthetic Antisense oligonucleotide
  misc_feature (1)..(1): bicyclic nucleic acid (BNA)
acaucaaggaagauggcauuucu

SEQ ID NO: 1875 - RNA, 22 nt, Artificial Sequence
  Description of Artificial Sequence: Synthetic Antisense oligonucleotide
  misc_feature (1)..(1): bicyclic nucleic acid (BNA)
acaucaaggaagauggcauuuc

SEQ ID NO: 1876 - RNA, 21 nt, Artificial Sequence
  Description of Artificial Sequence: Synthetic Antisense oligonucleotide
  misc_feature (1)..(1): bicyclic nucleic acid (BNA)
acaucaaggaagauggcauuu

SEQ ID NO: 1877 - RNA, 20 nt, Artificial Sequence
  Description of Artificial Sequence: Synthetic Antisense oligonucleotide
  misc_feature (1)..(1): bicyclic nucleic acid (BNA)
acaucaaggaagauggcauu

SEQ ID NO: 1878 - RNA, 19 nt, Artificial Sequence
  Description of Artificial Sequence: Synthetic Antisense oligonucleotide
  misc_feature (1)..(1): bicyclic nucleic acid (BNA)
acaucaaggaagauggcau

SEQ ID NO: 1879 - RNA, 18 nt, Artificial Sequence
  Description of Artificial Sequence: Synthetic Antisense oligonucleotide
  misc_feature (1)..(1): bicyclic nucleic acid (BNA)
acaucaaggaagauggca

SEQ ID NO: 1880 - RNA, 17 nt, Artificial Sequence
  Description of Artificial Sequence: Synthetic Antisense oligonucleotide
  misc_feature (1)..(1): bicyclic nucleic acid (BNA)
acaucaaggaagauggc

SEQ ID NO: 1881 - RNA, 16 nt, Artificial Sequence
  Description of Artificial Sequence: Synthetic Antisense oligonucleotide
  misc_feature (1)..(1): bicyclic nucleic acid (BNA)
acaucaaggaagaugg

SEQ ID NO: 1882 - RNA, 15 nt, Artificial Sequence
  Description of Artificial Sequence: Synthetic Antisense oligonucleotide
  misc_feature (1)..(1): bicyclic nucleic acid (BNA)
acaucaaggaagaug

SEQ ID NO: 1883 - RNA, 14 nt, Artificial Sequence
  Description of Artificial Sequence: Synthetic Antisense oligonucleotide
  misc_feature (1)..(1): bicyclic nucleic acid (BNA)
acaucaaggaagau

SEQ ID NO: 1884 - RNA, 13 nt, Artificial Sequence
  Description of Artificial Sequence: Synthetic Antisense oligonucleotide
  misc_feature (1)..(1): bicyclic nucleic acid (BNA)
acaucaaggaaga

SEQ ID NO: 1885 - RNA, 12 nt, Artificial Sequence
  Description of Artificial Sequence: Synthetic Antisense oligonucleotide
  misc_feature (1)..(1): bicyclic nucleic acid (BNA)
acaucaaggaag

SEQ ID NO: 1886 - RNA, 24 nt, Artificial Sequence
  Description of Artificial Sequence: Synthetic Antisense oligonucleotide
  misc_feature (1)..(1): bicyclic nucleic acid (BNA)
caucaaggaagauggcauuucuag

SEQ ID NO: 1887 - RNA, 23 nt, Artificial Sequence
  Description of Artificial Sequence: Synthetic Antisense oligonucleotide
  misc_feature (1)..(1): bicyclic nucleic acid (BNA)
caucaaggaagauggcauuucua

SEQ ID NO: 1888 - RNA, 22 nt, Artificial Sequence
  Description of Artificial Sequence: Synthetic Antisense oligonucleotide
  misc_feature (1)..(1): bicyclic nucleic acid (BNA)
caucaaggaagauggcauuucu

SEQ ID NO: 1889 - RNA, 21 nt, Artificial Sequence
  Description of Artificial Sequence: Synthetic Antisense oligonucleotide
  misc_feature (1)..(1): bicyclic nucleic acid (BNA)
caucaaggaagauggcauuuc

SEQ ID NO: 1890 - RNA, 20 nt, Artificial Sequence
  Description of Artificial Sequence: Synthetic Antisense oligonucleotide
  misc_feature (1)..(1): bicyclic nucleic acid (BNA)
caucaaggaagauggcauuu

SEQ ID NO: 1891 - RNA, 19 nt, Artificial Sequence
  Description of Artificial Sequence: Synthetic Antisense oligonucleotide
  misc_feature (1)..(1): bicyclic nucleic acid (BNA)
caucaaggaagauggcauu

SEQ ID NO: 1892 - RNA, 18 nt, Artificial Sequence
  Description of Artificial Sequence: Synthetic Antisense oligonucleotide
  misc_feature (1)..(1): bicyclic nucleic acid (BNA)
caucaaggaagauggcau

SEQ ID NO: 1893 - RNA, 17 nt, Artificial Sequence
  Description of Artificial Sequence: Synthetic Antisense oligonucleotide
  misc_feature (1)..(1): bicyclic nucleic acid (BNA)
caucaaggaagauggca

SEQ ID NO: 1894 - RNA, 16 nt, Artificial Sequence
  Description of Artificial Sequence: Synthetic Antisense oligonucleotide
  misc_feature (1)..(1): bicyclic nucleic acid (BNA)
caucaaggaagauggc

SEQ ID NO: 1895 - RNA, 15 nt, Artificial Sequence
  Description of Artificial Sequence: Synthetic Antisense oligonucleotide
  misc_feature (1)..(1): bicyclic nucleic acid (BNA)
caucaaggaagaugg

SEQ ID NO: 1896 - RNA, 14 nt, Artificial Sequence
  Description of Artificial Sequence: Synthetic Antisense oligonucleotide
  misc_feature (1)..(1): bicyclic nucleic acid (BNA)
caucaaggaagaug

SEQ ID NO: 1897 - RNA, 13 nt, Artificial Sequence
  Description of Artificial Sequence: Synthetic Antisense oligonucleotide
  misc_feature (1)..(1): bicyclic nucleic acid (BNA)
caucaaggaagau

SEQ ID NO: 1898 - RNA, 12 nt, Artificial Sequence
  Description of Artificial Sequence: Synthetic Antisense oligonucleotide
  misc_feature (1)..(1): bicyclic nucleic acid (BNA)
caucaaggaaga

SEQ ID NO: 1899 - RNA, 11 nt, Artificial Sequence
  Description of Artificial Sequence: Synthetic Antisense oligonucleotide
  misc_feature (1)..(1): bicyclic nucleic acid (BNA)
caucaaggaag

SEQ ID NO: 1900 - RNA, 23 nt, Artificial Sequence
  Description of Artificial Sequence: Synthetic Antisense oligonucleotide
  misc_feature (1)..(1): bicyclic nucleic acid (BNA)
aucaaggaagauggcauuucuag

SEQ ID NO: 1901 - RNA, 22 nt, Artificial Sequence
  Description of Artificial Sequence: Synthetic Antisense oligonucleotide
  misc_feature (1)..(1): bicyclic nucleic acid (BNA)
aucaaggaagauggcauuucua

SEQ ID NO: 1902 - RNA, 21 nt, Artificial Sequence
  Description of Artificial Sequence: Synthetic Antisense oligonucleotide
  misc_feature (1)..(1): bicyclic nucleic acid (BNA)
aucaaggaagauggcauuucu

SEQ ID NO: 1903 - RNA, 20 nt, Artificial Sequence
  Description of Artificial Sequence: Synthetic Antisense oligonucleotide
  misc_feature (1)..(1): bicyclic nucleic acid (BNA)
aucaaggaagauggcauuuc

SEQ ID NO: 1904 - RNA, 19 nt, Artificial Sequence
  Description of Artificial Sequence: Synthetic Antisense oligonucleotide
  misc_feature (1)..(1): bicyclic nucleic acid (BNA)
aucaaggaagauggcauuu

SEQ ID NO: 1905 - RNA, 18 nt, Artificial Sequence
  Description of Artificial Sequence: Synthetic Antisense oligonucleotide
  misc_feature (1)..(1): bicyclic nucleic acid (BNA)
aucaaggaagauggcauu

SEQ ID NO: 1906 - RNA, 17 nt, Artificial Sequence
  Description of Artificial Sequence: Synthetic Antisense oligonucleotide
  misc_feature (1)..(1): bicyclic nucleic acid (BNA)
aucaaggaagauggcau

SEQ ID NO: 1907 - RNA, 16 nt, Artificial Sequence
  Description of Artificial Sequence: Synthetic Antisense oligonucleotide
  misc_feature (1)..(1): bicyclic nucleic acid (BNA)
aucaaggaagauggca

SEQ ID NO: 1908 - RNA, 15 nt, Artificial Sequence
  Description of Artificial Sequence: Synthetic Antisense oligonucleotide
  misc_feature (1)..(1): bicyclic nucleic acid (BNA)
aucaaggaagauggc

SEQ ID NO: 1909 - RNA, 14 nt, Artificial Sequence
  Description of Artificial Sequence: Synthetic Antisense oligonucleotide
  misc_feature (1)..(1): bicyclic nucleic acid (BNA)
aucaaggaagaugg

SEQ ID NO: 1910 - RNA, 13 nt, Artificial Sequence
  Description of Artificial Sequence: Synthetic Antisense oligonucleotide
  misc_feature (1)..(1): bicyclic nucleic acid (BNA)
aucaaggaagaug

SEQ ID NO: 1911 - RNA, 12 nt, Artificial Sequence
  Description of Artificial Sequence: Synthetic Antisense oligonucleotide
  misc_feature (1)..(1): bicyclic nucleic acid (BNA)
aucaaggaagau

SEQ ID NO: 1912 - RNA, 11 nt, Artificial Sequence
  Description of Artificial Sequence: Synthetic Antisense oligonucleotide
  misc_feature (1)..(1): bicyclic nucleic acid (BNA)
aucaaggaaga

SEQ ID NO: 1913 - RNA, 10 nt, Artificial Sequence
  Description of Artificial Sequence: Synthetic Antisense oligonucleotide
  misc_feature (1)..(1): bicyclic nucleic acid (BNA)
aucaaggaag

SEQ ID NO: 1914 - RNA, 18 nt, Artificial Sequence
  Description of Artificial Sequence: Synthetic Antisense oligonucleotide
  misc_feature (18)..(18): bicyclic nucleic acid (BNA)
gguaaguucuguccaagc

SEQ ID NO: 1915 - RNA, 18 nt, Artificial Sequence
  Description of Artificial Sequence: Synthetic Antisense oligonucleotide
  misc_feature (18)..(18): bicyclic nucleic acid (BNA)
guaaguucuguccaagcc

SEQ ID NO: 1916 - RNA, 18 nt, Artificial Sequence
  Description of Artificial Sequence: Synthetic Antisense oligonucleotide
  misc_feature (18)..(18): bicyclic nucleic acid (BNA)
agucgguaaguucugucc

SEQ ID NO: 1917 - RNA, 18 nt, Artificial Sequence
  Description of Artificial Sequence: Synthetic Antisense oligonucleotide
  misc_feature (18)..(18): bicyclic nucleic acid (BNA)
cuguccaagcccgguuga

SEQ ID NO: 1918 - RNA, 15 nt, Artificial Sequence
  Description of Artificial Sequence: Synthetic Antisense oligonucleotide
  misc_feature (15)..(15): bicyclic nucleic acid (BNA)
uaaguucuguccaag

SEQ ID NO: 1919 - RNA, 20 nt, Artificial Sequence
  Description of Artificial Sequence: Synthetic Antisense oligonucleotide
  misc_feature (20)..(20): bicyclic nucleic acid (BNA)
uucuguccaagcccgguuga

SEQ ID NO: 1920 - RNA, 19 nt, Artificial Sequence
  Description of Artificial Sequence: Synthetic Antisense oligonucleotide
  misc_feature (19)..(19): bicyclic nucleic acid (BNA)
uucuguccaagcccgguug

SEQ ID NO: 1921 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(18): bicyclic nucleic acid (BNA)
uucuguccaagcccggut

SEQ ID NO: 1922 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(17): bicyclic nucleic acid (BNA)
uucuguccaagcccggt

SEQ ID NO: 1923 - RNA, 16 nt, Artificial Sequence
  Description of Artificial Sequence: Synthetic Antisense oligonucleotide
  misc_feature (16)..(16): bicyclic nucleic acid (BNA)
uucuguccaagcccgg

SEQ ID NO: 1924 - RNA, 15 nt, Artificial Sequence
  Description of Artificial Sequence: Synthetic Antisense oligonucleotide
  misc_feature (15)..(15): bicyclic nucleic acid (BNA)
uucuguccaagcccg

SEQ ID NO: 1925 - RNA, 14 nt, Artificial Sequence
  Description of Artificial Sequence: Synthetic Antisense oligonucleotide
  misc_feature (14)..(14): bicyclic nucleic acid (BNA)
uucuguccaagccc

SEQ ID NO: 1926 - RNA, 13 nt, Artificial Sequence
  Description of Artificial Sequence: Synthetic Antisense oligonucleotide
  misc_feature (13)..(13): bicyclic nucleic acid (BNA)
uucuguccaagcc

SEQ ID NO: 1927 - RNA, 12 nt, Artificial Sequence
  Description of Artificial Sequence: Synthetic Antisense oligonucleotide
  misc_feature (12)..(12): bicyclic nucleic acid (BNA)
uucuguccaagc

SEQ ID NO: 1928 - RNA, 11 nt, Artificial Sequence
  Description of Artificial Sequence: Synthetic Antisense oligonucleotide
  misc_feature (11)..(11): bicyclic nucleic acid (BNA)
uucuguccaag

SEQ ID NO: 1929 - RNA, 10 nt, Artificial Sequence
  Description of Artificial Sequence: Synthetic Antisense oligonucleotide
  misc_feature (10)..(10): bicyclic nucleic acid (BNA)
uucuguccaa

SEQ ID NO: 1930 - RNA, 9 nt, Artificial Sequence
  Description of Artificial Sequence: Synthetic Antisense oligonucleotide
  misc_feature (9)..(9): bicyclic nucleic acid (BNA)
uucugucca

SEQ ID NO: 1931 - RNA, 8 nt, Artificial Sequence
  Description of Artificial Sequence: Synthetic Antisense oligonucleotide
  misc_feature (8)..(8): bicyclic nucleic acid (BNA)
uucugucc

SEQ ID NO: 1932 - RNA, 19 nt, Artificial Sequence
  Description of Artificial Sequence: Synthetic Antisense oligonucleotide
  misc_feature (19)..(19): bicyclic nucleic acid (BNA)
ucuguccaagcccgguuga

SEQ ID NO: 1933 - RNA, 18 nt, Artificial Sequence
  Description of Artificial Sequence: Synthetic Antisense oligonucleotide
  misc_feature (18)..(18): bicyclic nucleic acid (BNA)
ucuguccaagcccgguug

SEQ ID NO: 1934 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(17): bicyclic nucleic acid (BNA)
ucuguccaagcccggut

SEQ ID NO: 1935 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(16): bicyclic nucleic acid (BNA)
ucuguccaagcccggt

SEQ ID NO: 1936 - RNA, 15 nt, Artificial Sequence
  Description of Artificial Sequence: Synthetic Antisense oligonucleotide
  misc_feature (15)..(15): bicyclic nucleic acid (BNA)
ucuguccaagcccgg

SEQ ID NO: 1937 - RNA, 14 nt, Artificial Sequence
  Description of Artificial Sequence: Synthetic Antisense oligonucleotide
  misc_feature (14)..(14): bicyclic nucleic acid (BNA)
ucuguccaagcccg

SEQ ID NO: 1938 - RNA, 13 nt, Artificial Sequence
  Description of Artificial Sequence: Synthetic Antisense oligonucleotide
  misc_feature (13)..(13): bicyclic nucleic acid (BNA)
ucuguccaagccc

SEQ ID NO: 1939 - RNA, 12 nt, Artificial Sequence
  Description of Artificial Sequence: Synthetic Antisense oligonucleotide
  misc_feature (12)..(12): bicyclic nucleic acid (BNA)
ucuguccaagcc

SEQ ID NO: 1940 - RNA, 11 nt, Artificial Sequence
  Description of Artificial Sequence: Synthetic Antisense oligonucleotide
  misc_feature (11)..(11): bicyclic nucleic acid (BNA)
ucuguccaagc

SEQ ID NO: 1941 - RNA, 10 nt, Artificial Sequence
  Description of Artificial Sequence: Synthetic Antisense oligonucleotide
  misc_feature (10)..(10): bicyclic nucleic acid (BNA)
ucuguccaag

SEQ ID NO: 1942 - RNA, 9 nt, Artificial Sequence
  Description of Artificial Sequence: Synthetic Antisense oligonucleotide
  misc_feature (9)..(9): bicyclic nucleic acid (BNA)
ucuguccaa

SEQ ID NO: 1943 - RNA, 8 nt, Artificial Sequence
  Description of Artificial Sequence: Synthetic Antisense oligonucleotide
  misc_feature (8)..(8): bicyclic nucleic acid (BNA)
ucugucca

SEQ ID NO: 1944 - RNA, 17 nt, Artificial Sequence
  Description of Artificial Sequence: Synthetic Antisense oligonucleotide
  misc_feature (17)..(17): bicyclic nucleic acid (BNA)
cuguccaagcccgguug

SEQ ID NO: 1945 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(16): bicyclic nucleic acid (BNA)
cuguccaagcccggut

SEQ ID NO: 1946 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(15): bicyclic nucleic acid (BNA)
cuguccaagcccggt

SEQ ID NO: 1947 - RNA, 14 nt, Artificial Sequence
  Description of Artificial Sequence: Synthetic Antisense oligonucleotide
  misc_feature (14)..(14): bicyclic nucleic acid (BNA)
cuguccaagcccgg

SEQ ID NO: 1948 - RNA, 13 nt, Artificial Sequence
  Description of Artificial Sequence: Synthetic Antisense oligonucleotide
  misc_feature (13)..(13): bicyclic nucleic acid (BNA)
cuguccaagcccg

SEQ ID NO: 1949 - RNA, 12 nt, Artificial Sequence
  Description of Artificial Sequence: Synthetic Antisense oligonucleotide
  misc_feature (12)..(12): bicyclic nucleic acid (BNA)
cuguccaagccc

SEQ ID NO: 1950 - RNA, 11 nt, Artificial Sequence
  Description of Artificial Sequence: Synthetic Antisense oligonucleotide
  misc_feature (11)..(11): bicyclic nucleic acid (BNA)
cuguccaagcc

SEQ ID NO: 1951 - RNA, 10 nt, Artificial Sequence
  Description of Artificial Sequence: Synthetic Antisense oligonucleotide
  misc_feature (10)..(10): bicyclic nucleic acid (BNA)
cuguccaagc

SEQ ID NO: 1952 - RNA, 9 nt, Artificial Sequence
  Description of Artificial Sequence: Synthetic Antisense oligonucleotide
  misc_feature (9)..(9): bicyclic nucleic acid (BNA)
cuguccaag

SEQ ID NO: 1953 - RNA, 8 nt, Artificial Sequence
  Description of Artificial Sequence: Synthetic Antisense oligonucleotide
  misc_feature (8)..(8): bicyclic nucleic acid (BNA)
cuguccaa

SEQ ID NO: 1954 - RNA, 20 nt, Artificial Sequence
  Description of Artificial Sequence: Synthetic Antisense oligonucleotide
  misc_feature (20)..(20): bicyclic nucleic acid (BNA)
guucuguccaagcccgguug

SEQ ID NO: 1955 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(19): bicyclic nucleic acid (BNA)
guucuguccaagcccggut

SEQ ID NO: 1956 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(18): bicyclic nucleic acid (BNA)
guucuguccaagcccggt

SEQ ID NO: 1957 - RNA, 17 nt, Artificial Sequence
  Description of Artificial Sequence: Synthetic Antisense oligonucleotide
  misc_feature (17)..(17): bicyclic nucleic acid (BNA)
guucuguccaagcccgg

SEQ ID NO: 1958 - RNA, 16 nt, Artificial Sequence
  Description of Artificial Sequence: Synthetic Antisense oligonucleotide
  misc_feature (16)..(16): bicyclic nucleic acid (BNA)
guucuguccaagcccg

SEQ ID NO: 1959 - RNA, 15 nt, Artificial Sequence
  Description of Artificial Sequence: Synthetic Antisense oligonucleotide
  misc_feature (15)..(15): bicyclic nucleic acid (BNA)
guucuguccaagccc

SEQ ID NO: 1960 - RNA, 14 nt, Artificial Sequence
  Description of Artificial Sequence: Synthetic Antisense oligonucleotide
  misc_feature (14)..(14): bicyclic nucleic acid (BNA)
guucuguccaagcc

SEQ ID NO: 1961 - RNA, 13 nt, Artificial Sequence
  Description of Artificial Sequence: Synthetic Antisense oligonucleotide
  misc_feature (13)..(13): bicyclic nucleic acid (BNA)
guucuguccaagc

SEQ ID NO: 1962 - RNA, 12 nt, Artificial Sequence
  Description of Artificial Sequence: Synthetic Antisense oligonucleotide
  misc_feature (12)..(12): bicyclic nucleic acid (BNA)
guucuguccaag

SEQ ID NO: 1963 - RNA, 11 nt, Artificial Sequence
  Description of Artificial Sequence: Synthetic Antisense oligonucleotide
  misc_feature (11)..(11): bicyclic nucleic acid (BNA)
guucuguccaa

SEQ ID NO: 1964 - RNA, 10 nt, Artificial Sequence
  Description of Artificial Sequence: Synthetic Antisense oligonucleotide
  misc_feature (10)..(10): bicyclic nucleic acid (BNA)
guucugucca

SEQ ID NO: 1965 - RNA, 9 nt, Artificial Sequence
  Description of Artificial Sequence: Synthetic Antisense oligonucleotide
  misc_feature (9)..(9): bicyclic nucleic acid (BNA)
guucugucc

SEQ ID NO: 1966 - RNA, 8 nt, Artificial Sequence
  Description of Artificial Sequence: Synthetic Antisense oligonucleotide
  misc_feature (8)..(8): bicyclic nucleic acid (BNA)
guucuguc

SEQ ID NO: 1967 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (20)..(20): bicyclic nucleic acid (BNA)
aguucuguccaagcccggut

SEQ ID NO: 1968 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(19): bicyclic nucleic acid (BNA)
aguucuguccaagcccggt

SEQ ID NO: 1969 - RNA, 18 nt, Artificial Sequence
  Description of Artificial Sequence: Synthetic Antisense oligonucleotide
  misc_feature (18)..(18): bicyclic nucleic acid (BNA)
aguucuguccaagcccgg

SEQ ID NO: 1970 - RNA, 17 nt, Artificial Sequence
  Description of Artificial Sequence: Synthetic Antisense oligonucleotide
  misc_feature (17)..(17): bicyclic nucleic acid (BNA)
aguucuguccaagcccg

SEQ ID NO: 1971 - RNA, 16 nt, Artificial Sequence
  Description of Artificial Sequence: Synthetic Antisense oligonucleotide
  misc_feature (16)..(16): bicyclic nucleic acid (BNA)
aguucuguccaagccc

SEQ ID NO: 1972 - RNA, 15 nt, Artificial Sequence
  Description of Artificial Sequence: Synthetic Antisense oligonucleotide
  misc_feature (15)..(15): bicyclic nucleic acid (BNA)
aguucuguccaagcc

SEQ ID NO: 1973 - RNA, 14 nt, Artificial Sequence
  Description of Artificial Sequence: Synthetic Antisense oligonucleotide
  misc_feature (14)..(14): bicyclic nucleic acid (BNA)
aguucuguccaagc

SEQ ID NO: 1974 - RNA, 13 nt, Artificial Sequence
  Description of Artificial Sequence: Synthetic Antisense oligonucleotide
  misc_feature (13)..(13): bicyclic nucleic acid (BNA)
aguucuguccaag

SEQ ID NO: 1975 - RNA, 12 nt, Artificial Sequence
  Description of Artificial Sequence: Synthetic Antisense oligonucleotide
  misc_feature (12)..(12): bicyclic nucleic acid (BNA)
aguucuguccaa

SEQ ID NO: 1976 - RNA, 11 nt, Artificial Sequence
  Description of Artificial Sequence: Synthetic Antisense oligonucleotide
  misc_feature (11)..(11): bicyclic nucleic acid (BNA)
aguucugucca

SEQ ID NO: 1977 - RNA, 10 nt, Artificial Sequence
  Description of Artificial Sequence: Synthetic Antisense oligonucleotide
  misc_feature (10)..(10): bicyclic nucleic acid (BNA)
aguucugucc

SEQ ID NO: 1978 - RNA, 9 nt, Artificial Sequence
  Description of Artificial Sequence: Synthetic Antisense oligonucleotide
  misc_feature (9)..(9): bicyclic nucleic acid (BNA)
aguucuguc

SEQ ID NO: 1979 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): bicyclic nucleic acid (BNA)
aguucugt

SEQ ID NO: 1980 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (20)..(20): bicyclic nucleic acid (BNA)
aaguucuguccaagcccggt

SEQ ID NO: 1981 - RNA, 19 nt, Artificial Sequence
  Description of Artificial Sequence: Synthetic Antisense oligonucleotide
  misc_feature (19)..(19): bicyclic nucleic acid (BNA)
aaguucuguccaagcccgg

SEQ ID NO: 1982 - RNA, 18 nt, Artificial Sequence
  Description of Artificial Sequence: Synthetic Antisense oligonucleotide
  misc_feature (18)..(18): bicyclic nucleic acid (BNA)
aaguucuguccaagcccg

SEQ ID NO: 1983 - RNA, 17 nt, Artificial Sequence
  Description of Artificial Sequence: Synthetic Antisense oligonucleotide
  misc_feature (17)..(17): bicyclic nucleic acid (BNA)
aaguucuguccaagccc

SEQ ID NO: 1984 - RNA, 16 nt, Artificial Sequence
  Description of Artificial Sequence: Synthetic Antisense oligonucleotide
  misc_feature (16)..(16): bicyclic nucleic acid (BNA)
aaguucuguccaagcc

SEQ ID NO: 1985 - RNA, 15 nt, Artificial Sequence
  Description of Artificial Sequence: Synthetic Antisense oligonucleotide
  misc_feature (15)..(15): bicyclic nucleic acid (BNA)
aaguucuguccaagc

SEQ ID NO: 1986 - RNA, 14 nt, Artificial Sequence
  Description of Artificial Sequence: Synthetic Antisense oligonucleotide
  misc_feature (14)..(14): bicyclic nucleic acid (BNA)
aaguucuguccaag

SEQ ID NO: 1987 - RNA, 13 nt, Artificial Sequence
  Description of Artificial Sequence: Synthetic Antisense oligonucleotide
  misc_feature (13)..(13): bicyclic nucleic acid (BNA)
aaguucuguccaa

SEQ ID NO: 1988 - RNA, 12 nt, Artificial Sequence
  Description of Artificial Sequence: Synthetic Antisense oligonucleotide
  misc_feature (12)..(12): bicyclic nucleic acid (BNA)
aaguucugucca

SEQ ID NO: 1989 - RNA, 11 nt, Artificial Sequence
  Description of Artificial Sequence: Synthetic Antisense oligonucleotide
  misc_feature (11)..(11): bicyclic nucleic acid (BNA)
aaguucugucc

SEQ ID NO: 1990 - RNA, 10 nt, Artificial Sequence
  Description of Artificial Sequence: Synthetic Antisense oligonucleotide
  misc_feature (10)..(10): bicyclic nucleic acid (BNA)
aaguucuguc

SEQ ID NO: 1991 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): bicyclic nucleic acid (BNA)
aaguucugt

SEQ ID NO: 1992 - RNA, 8 nt, Artificial Sequence
  Description of Artificial Sequence: Synthetic Antisense oligonucleotide
  misc_feature (8)..(8): bicyclic nucleic acid (BNA)
aaguucug

SEQ ID NO: 1993 - RNA, 20 nt, Artificial Sequence
  Description of Artificial Sequence: Synthetic Antisense oligonucleotide
  misc_feature (20)..(20): bicyclic nucleic acid (BNA)
uaaguucuguccaagcccgg

SEQ ID NO: 1994 - RNA, 19 nt, Artificial Sequence
  Description of Artificial Sequence: Synthetic Antisense oligonucleotide
  misc_feature (19)..(19): bicyclic nucleic acid (BNA)
uaaguucuguccaagcccg

SEQ ID NO: 1995 - RNA, 18 nt, Artificial Sequence
  Description of Artificial Sequence: Synthetic Antisense oligonucleotide
  misc_feature (18)..(18): bicyclic nucleic acid (BNA)
uaaguucuguccaagccc

SEQ ID NO: 1996 - RNA, 17 nt, Artificial Sequence
  Description of Artificial Sequence: Synthetic Antisense oligonucleotide
  misc_feature (17)..(17): bicyclic nucleic acid (BNA)
uaaguucuguccaagcc

SEQ ID NO: 1997 - RNA, 16 nt, Artificial Sequence
  Description of Artificial Sequence: Synthetic Antisense oligonucleotide
  misc_feature (16)..(16): bicyclic nucleic acid (BNA)
uaaguucuguccaagc

SEQ ID NO: 1998 - RNA, 14 nt, Artificial Sequence
  Description of Artificial Sequence: Synthetic Antisense oligonucleotide
  misc_feature (14)..(14): bicyclic nucleic acid (BNA)
uaaguucuguccaa

SEQ ID NO: 1999 - RNA, 13 nt, Artificial Sequence
  Description of Artificial Sequence: Synthetic Antisense oligonucleotide
  misc_feature (13)..(13): bicyclic nucleic acid (BNA)
uaaguucugucca

SEQ ID NO: 2000 - RNA, 12 nt, Artificial Sequence
  Description of Artificial Sequence: Synthetic Antisense oligonucleotide
  misc_feature (12)..(12): bicyclic nucleic acid (BNA)
uaaguucugucc

SEQ ID NO: 2001 - RNA, 11 nt, Artificial Sequence
  Description of Artificial Sequence: Synthetic Antisense oligonucleotide
  misc_feature (11)..(11): bicyclic nucleic acid (BNA)
uaaguucuguc

SEQ ID NO: 2002 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(10): bicyclic nucleic acid (BNA)
uaaguucugt

SEQ ID NO: 2003 - RNA, 9 nt, Artificial Sequence
  Description of Artificial Sequence: Synthetic Antisense oligonucleotide
  misc_feature (9)..(9): bicyclic nucleic acid (BNA)
uaaguucug

SEQ ID NO: 2004 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): bicyclic nucleic acid (BNA)
uaaguuct

SEQ ID NO: 2005 - RNA, 20 nt, Artificial Sequence
  Description of Artificial Sequence: Synthetic Antisense oligonucleotide
  misc_feature (20)..(20): bicyclic nucleic acid (BNA)
guaaguucuguccaagcccg

SEQ ID NO: 2006 - RNA, 19 nt, Artificial Sequence
  Description of Artificial Sequence: Synthetic Antisense oligonucleotide
  misc_feature (19)..(19): bicyclic nucleic acid (BNA)
guaaguucuguccaagccc

SEQ ID NO: 2007 - RNA, 17 nt, Artificial Sequence
  Description of Artificial Sequence: Synthetic Antisense oligonucleotide
  misc_feature (17)..(17): bicyclic nucleic acid (BNA)
guaaguucuguccaagc

SEQ ID NO: 2008 - RNA, 16 nt, Artificial Sequence
  Description of Artificial Sequence: Synthetic Antisense oligonucleotide
  misc_feature (16)..(16): bicyclic nucleic acid (BNA)
guaaguucuguccaag

SEQ ID NO: 2009 - RNA, 15 nt, Artificial Sequence
  Description of Artificial Sequence: Synthetic Antisense oligonucleotide
  misc_feature (15)..(15): bicyclic nucleic acid (BNA)
guaaguucuguccaa

SEQ ID NO: 2010 - RNA, 14 nt, Artificial Sequence
  Description of Artificial Sequence: Synthetic Antisense oligonucleotide
  misc_feature (14)..(14): bicyclic nucleic acid (BNA)
guaaguucugucca

SEQ ID NO: 2011 - RNA, 13 nt, Artificial Sequence
  Description of Artificial Sequence: Synthetic Antisense oligonucleotide
  misc_feature (13)..(13): bicyclic nucleic acid (BNA)
guaaguucugucc

SEQ ID NO: 2012 - RNA, 12 nt, Artificial Sequence
  Description of Artificial Sequence: Synthetic Antisense oligonucleotide
  misc_feature (12)..(12): bicyclic nucleic acid (BNA)
guaaguucuguc

SEQ ID NO: 2013 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): bicyclic nucleic acid (BNA)
guaaguucugt

SEQ ID NO: 2014 - RNA, 10 nt, Artificial Sequence
  Description of Artificial Sequence: Synthetic Antisense oligonucleotide
  misc_feature (10)..(10): bicyclic nucleic acid (BNA)
guaaguucug

SEQ ID NO: 2015 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): bicyclic nucleic acid (BNA)
guaaguuct

SEQ ID NO: 2016 - RNA, 8 nt, Artificial Sequence
  Description of Artificial Sequence: Synthetic Antisense oligonucleotide
  misc_feature (8)..(8): bicyclic nucleic acid (BNA)
guaaguuc

SEQ ID NO: 2017 - RNA, 20 nt, Artificial Sequence
  Description of Artificial Sequence: Synthetic Antisense oligonucleotide
  misc_feature (20)..(20): bicyclic nucleic acid (BNA)
gguaaguucuguccaagccc

SEQ ID NO: 2018 - RNA, 19 nt, Artificial Sequence
  Description of Artificial Sequence: Synthetic Antisense oligonucleotide
  misc_feature (19)..(19): bicyclic nucleic acid (BNA)
gguaaguucuguccaagcc

SEQ ID NO: 2019 - RNA, 17 nt, Artificial Sequence
  Description of Artificial Sequence: Synthetic Antisense oligonucleotide
  misc_feature (17)..(17): bicyclic nucleic acid (BNA)
gguaaguucuguccaag

SEQ ID NO: 2020 - RNA, 16 nt, Artificial Sequence
  Description of Artificial Sequence: Synthetic Antisense oligonucleotide
  misc_feature (16)..(16): bicyclic nucleic acid (BNA)
gguaaguucuguccaa

SEQ ID NO: 2021 - RNA, 15 nt, Artificial Sequence
  Description of Artificial Sequence: Synthetic Antisense oligonucleotide
  misc_feature (15)..(15): bicyclic nucleic acid (BNA)
gguaaguucugucca

SEQ ID NO: 2022 - RNA, 14 nt, Artificial Sequence
  Description of Artificial Sequence: Synthetic Antisense oligonucleotide
  misc_feature (14)..(14): bicyclic nucleic acid (BNA)
gguaaguucugucc

SEQ ID NO: 2023 - RNA, 13 nt, Artificial Sequence
  Description of Artificial Sequence: Synthetic Antisense oligonucleotide
  misc_feature (13)..(13): bicyclic nucleic acid (BNA)
gguaaguucuguc

SEQ ID NO: 2024 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): bicyclic nucleic acid (BNA)
gguaaguucugt

SEQ ID NO: 2025 - RNA, 11 nt, Artificial Sequence
  Description of Artificial Sequence: Synthetic Antisense oligonucleotide
  misc_feature (11)..(11): bicyclic nucleic acid (BNA)
gguaaguucug

SEQ ID NO: 2026 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(10): bicyclic nucleic acid (BNA)
gguaaguuct

SEQ ID NO: 2027 - RNA, 9 nt, Artificial Sequence
  Description of Artificial Sequence: Synthetic Antisense oligonucleotide
  misc_feature (9)..(9): bicyclic nucleic acid (BNA)
gguaaguuc

SEQ ID NO: 2028 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): bicyclic nucleic acid (BNA)
gguaagut

SEQ ID NO: 2029 - RNA, 20 nt, Artificial Sequence
  Description of Artificial Sequence: Synthetic Antisense oligonucleotide
  misc_feature (20)..(20): bicyclic nucleic acid (BNA)
cgguaaguucuguccaagcc

SEQ ID NO: 2030 - RNA, 19 nt, Artificial Sequence
  Description of Artificial Sequence: Synthetic Antisense oligonucleotide
  misc_feature (19)..(19): bicyclic nucleic acid (BNA)
cgguaaguucuguccaagc

SEQ ID NO: 2031 - RNA, 18 nt, Artificial Sequence
  Description of Artificial Sequence: Synthetic Antisense oligonucleotide
  misc_feature (18)..(18): bicyclic nucleic acid (BNA)
cgguaaguucuguccaag

SEQ ID NO: 2032 - RNA, 17 nt, Artificial Sequence
  Description of Artificial Sequence: Synthetic Antisense oligonucleotide
  misc_feature (17)..(17): bicyclic nucleic acid (BNA)
cgguaaguucuguccaa

SEQ ID NO: 2033 - RNA, 16 nt, Artificial Sequence
  Description of Artificial Sequence: Synthetic Antisense oligonucleotide
  misc_feature (16)..(16): bicyclic nucleic acid (BNA)
cgguaaguucugucca

SEQ ID NO: 2034 - RNA, 15 nt, Artificial Sequence
  Description of Artificial Sequence: Synthetic Antisense oligonucleotide
  misc_feature (15)..(15): bicyclic nucleic acid (BNA)
cgguaaguucugucc

SEQ ID NO: 2035 - RNA, 14 nt, Artificial Sequence
  Description of Artificial Sequence: Synthetic Antisense oligonucleotide
  misc_feature (14)..(14): bicyclic nucleic acid (BNA)
cgguaaguucuguc

SEQ ID NO: 2036 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(13): bicyclic nucleic acid (BNA)
cgguaaguucugt

SEQ ID NO: 2037 - RNA, 12 nt, Artificial Sequence
  Description of Artificial Sequence: Synthetic Antisense oligonucleotide
  misc_feature (12)..(12): bicyclic nucleic acid (BNA)
cgguaaguucug

SEQ ID NO: 2038 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): bicyclic nucleic acid (BNA)
cgguaaguuct

SEQ ID NO: 2039 - RNA, 10 nt, Artificial Sequence
  Description of Artificial Sequence: Synthetic Antisense oligonucleotide
  misc_feature (10)..(10): bicyclic nucleic acid (BNA)
cgguaaguuc

SEQ ID NO: 2040 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): bicyclic nucleic acid (BNA)
cgguaagut

SEQ ID NO: 2041 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): bicyclic nucleic acid (BNA)
cgguaagt

SEQ ID NO: 2042 - RNA, 20 nt, Artificial Sequence
  Description of Artificial Sequence: Synthetic Antisense oligonucleotide
  misc_feature (20)..(20): bicyclic nucleic acid (BNA)
ucgguaaguucuguccaagc

SEQ ID NO: 2043 - RNA, 19 nt, Artificial Sequence
  Description of Artificial Sequence: Synthetic Antisense oligonucleotide
  misc_feature (19)..(19): bicyclic nucleic acid (BNA)
ucgguaaguucuguccaag

SEQ ID NO: 2044 - RNA, 18 nt, Artificial Sequence
  Description of Artificial Sequence: Synthetic Antisense oligonucleotide
  misc_feature (18)..(18): bicyclic nucleic acid (BNA)
ucgguaaguucuguccaa

SEQ ID NO: 2045 - RNA, 17 nt, Artificial Sequence
  Description of Artificial Sequence: Synthetic Antisense oligonucleotide
  misc_feature (17)..(17): bicyclic nucleic acid (BNA)
ucgguaaguucugucca

SEQ ID NO: 2046 - RNA, 16 nt, Artificial Sequence
  Description of Artificial Sequence: Synthetic Antisense oligonucleotide
  misc_feature (16)..(16): bicyclic nucleic acid (BNA)
ucgguaaguucugucc

SEQ ID NO: 2047 - RNA, 15 nt, Artificial Sequence
  Description of Artificial Sequence: Synthetic Antisense oligonucleotide
  misc_feature (15)..(15): bicyclic nucleic acid (BNA)
ucgguaaguucuguc

SEQ ID NO: 2048 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(14): bicyclic nucleic acid (BNA)
ucgguaaguucugt

SEQ ID NO: 2049 - RNA, 13 nt, Artificial Sequence
  Description of Artificial Sequence: Synthetic Antisense oligonucleotide
  misc_feature (13)..(13): bicyclic nucleic acid (BNA)
ucgguaaguucug

SEQ ID NO: 2050 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): bicyclic nucleic acid (BNA)
ucgguaaguuct

SEQ ID NO: 2051 - RNA, 11 nt, Artificial Sequence
  Description of Artificial Sequence: Synthetic Antisense oligonucleotide
  misc_feature (11)..(11): bicyclic nucleic acid (BNA)
ucgguaaguuc

SEQ ID NO: 2052 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(10): bicyclic nucleic acid (BNA)
ucgguaagut

SEQ ID NO: 2053 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): bicyclic nucleic acid (BNA)
ucgguaagt

SEQ ID NO: 2054 - RNA, 20 nt, Artificial Sequence
  Description of Artificial Sequence: Synthetic Antisense oligonucleotide
  misc_feature (20)..(20): bicyclic nucleic acid (BNA)
gucgguaaguucuguccaag

SEQ ID NO: 2055 - RNA, 19 nt, Artificial Sequence
  Description of Artificial Sequence: Synthetic Antisense oligonucleotide
  misc_feature (19)..(19): bicyclic nucleic acid (BNA)
gucgguaaguucuguccaa

SEQ ID NO: 2056 - RNA, 18 nt, Artificial Sequence
  Description of Artificial Sequence: Synthetic Antisense oligonucleotide
  misc_feature (18)..(18): bicyclic nucleic acid (BNA)
gucgguaaguucugucca

SEQ ID NO: 2057 - RNA, 17 nt, Artificial Sequence
  Description of Artificial Sequence: Synthetic Antisense oligonucleotide
  misc_feature (17)..(17): bicyclic nucleic acid (BNA)
gucgguaaguucugucc

SEQ ID NO: 2058 - RNA, 16 nt, Artificial Sequence
  Description of Artificial Sequence: Synthetic Antisense oligonucleotide
  misc_feature (16)..(16): bicyclic nucleic acid (BNA)
gucgguaaguucuguc

SEQ ID NO: 2059 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(15): bicyclic nucleic acid (BNA)
gucgguaaguucugt

SEQ ID NO: 2060 - RNA, 14 nt, Artificial Sequence
  Description of Artificial Sequence: Synthetic Antisense oligonucleotide
  misc_feature (14)..(14): bicyclic nucleic acid (BNA)
gucgguaaguucug

SEQ ID NO: 2061 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(13): bicyclic nucleic acid (BNA)
gucgguaaguuct

SEQ ID NO: 2062 - RNA, 12 nt, Artificial Sequence
  Description of Artificial Sequence: Synthetic Antisense oligonucleotide
  misc_feature (12)..(12): bicyclic nucleic acid (BNA)
gucgguaaguuc

SEQ ID NO: 2063 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): bicyclic nucleic acid (BNA)
gucgguaagut

SEQ ID NO: 2064 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(10): bicyclic nucleic acid (BNA)
gucgguaagt

SEQ ID NO: 2065 - RNA, 20 nt, Artificial Sequence
  Description of Artificial Sequence: Synthetic Antisense oligonucleotide
  misc_feature (20)..(20): bicyclic nucleic acid (BNA)
agucgguaaguucuguccaa

SEQ ID NO: 2066 - RNA, 19 nt, Artificial Sequence
  Description of Artificial Sequence: Synthetic Antisense oligonucleotide
  misc_feature (19)..(19): bicyclic nucleic acid (BNA)
agucgguaaguucugucca

SEQ ID NO: 2067 - RNA, 17 nt, Artificial Sequence
  Description of Artificial Sequence: Synthetic Antisense oligonucleotide
  misc_feature (17)..(17): bicyclic nucleic acid (BNA)
agucgguaaguucuguc

SEQ ID NO: 2068 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(16): bicyclic nucleic acid (BNA)
agucgguaaguucugt

SEQ ID NO: 2069 - RNA, 15 nt, Artificial Sequence
  Description of Artificial Sequence: Synthetic Antisense oligonucleotide
  misc_feature (15)..(15): bicyclic nucleic acid (BNA)
agucgguaaguucug

SEQ ID NO: 2070 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(14): bicyclic nucleic acid (BNA)
agucgguaaguuct

SEQ ID NO: 2071 - RNA, 13 nt, Artificial Sequence
  Description of Artificial Sequence: Synthetic Antisense oligonucleotide
  misc_feature (13)..(13): bicyclic nucleic acid (BNA)
agucgguaaguuc

SEQ ID NO: 2072 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): bicyclic nucleic acid (BNA)
agucgguaagut

SEQ ID NO: 2073 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): bicyclic nucleic acid (BNA)
agucgguaagt

SEQ ID NO: 2074 - RNA, 20 nt, Artificial Sequence
  Description of Artificial Sequence: Synthetic Antisense oligonucleotide
  misc_feature (20)..(20): bicyclic nucleic acid (BNA)
cagucgguaaguucugucca

SEQ ID NO: 2075 - RNA, 19 nt, Artificial Sequence
  Description of Artificial Sequence: Synthetic Antisense oligonucleotide
  misc_feature (19)..(19): bicyclic nucleic acid (BNA)
cagucgguaaguucugucc

SEQ ID NO: 2076 - RNA, 18 nt, Artificial Sequence
  Description of Artificial Sequence: Synthetic Antisense oligonucleotide
  misc_feature (18)..(18): bicyclic nucleic acid (BNA)
cagucgguaaguucuguc

SEQ ID NO: 2077 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(17): bicyclic nucleic acid (BNA)
cagucgguaaguucugt

SEQ ID NO: 2078 - RNA, 16 nt, Artificial Sequence
  Description of Artificial Sequence: Synthetic Antisense oligonucleotide
  misc_feature (16)..(16): bicyclic nucleic acid (BNA)
cagucgguaaguucug

SEQ ID NO: 2079 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(15): bicyclic nucleic acid (BNA)
cagucgguaaguuct

SEQ ID NO: 2080 - RNA, 14 nt, Artificial Sequence
  Description of Artificial Sequence: Synthetic Antisense oligonucleotide
  misc_feature (14)..(14): bicyclic nucleic acid (BNA)
cagucgguaaguuc

SEQ ID NO: 2081 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(13): bicyclic nucleic acid (BNA)
cagucgguaagut

SEQ ID NO: 2082 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): bicyclic nucleic acid (BNA)
cagucgguaagt

SEQ ID NO: 2083 - RNA, 20 nt, Artificial Sequence
  Description of Artificial Sequence: Synthetic Antisense oligonucleotide
  misc_feature (20)..(20): bicyclic nucleic acid (BNA)
ccagucgguaaguucugucc

SEQ ID NO: 2084 - RNA, 19 nt, Artificial Sequence
  Description of Artificial Sequence: Synthetic Antisense oligonucleotide
  misc_feature (19)..(19): bicyclic nucleic acid (BNA)
ccagucgguaaguucuguc

SEQ ID NO: 2085 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(18): bicyclic nucleic acid (BNA)
ccagucgguaaguucugt

SEQ ID NO: 2086 - RNA, 17 nt, Artificial Sequence
  Description of Artificial Sequence: Synthetic Antisense oligonucleotide
  misc_feature (17)..(17): bicyclic nucleic acid (BNA)
ccagucgguaaguucug

SEQ ID NO: 2087 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(16): bicyclic nucleic acid (BNA)
ccagucgguaaguuct

SEQ ID NO: 2088 - RNA, 15 nt, Artificial Sequence
  Description of Artificial Sequence: Synthetic Antisense oligonucleotide
  misc_feature (15)..(15): bicyclic nucleic acid (BNA)
ccagucgguaaguuc

SEQ ID NO: 2089 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(14): bicyclic nucleic acid (BNA)
ccagucgguaagut

SEQ ID NO: 2090 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(13): bicyclic nucleic acid (BNA)
ccagucgguaagt

SEQ ID NO: 2091 - RNA, 20 nt, Artificial Sequence
  Description of Artificial Sequence: Synthetic Antisense oligonucleotide
  misc_feature (20)..(20): bicyclic nucleic acid (BNA)
gccagucgguaaguucuguc

SEQ ID NO: 2092 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(19): bicyclic nucleic acid (BNA)
gccagucgguaaguucugt

SEQ ID NO: 2093 - RNA, 18 nt, Artificial Sequence
  Description of Artificial Sequence: Synthetic Antisense oligonucleotide
  misc_feature (18)..(18): bicyclic nucleic acid (BNA)
gccagucgguaaguucug

SEQ ID NO: 2094 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(17): bicyclic nucleic acid (BNA)
gccagucgguaaguuct

SEQ ID NO: 2095 - RNA, 16 nt, Artificial Sequence
  Description of Artificial Sequence: Synthetic Antisense oligonucleotide
  misc_feature (16)..(16): bicyclic nucleic acid (BNA)
gccagucgguaaguuc

SEQ ID NO: 2096 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(15): bicyclic nucleic acid (BNA)
gccagucgguaagut

SEQ ID NO: 2097 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(14): bicyclic nucleic acid (BNA)
gccagucgguaagt

SEQ ID NO: 2098 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (20)..(20): bicyclic nucleic acid (BNA)
ucaaggaagauggcauuuct

SEQ ID NO: 2099 - RNA, 22 nt, Artificial Sequence
  Description of Artificial Sequence: Synthetic Antisense oligonucleotide
  misc_feature (22)..(22): bicyclic nucleic acid (BNA)
ucaaggaagauggcauuucuag

SEQ ID NO: 2100 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(16): bicyclic nucleic acid (BNA)
ucaaggaagauggcat

SEQ ID NO: 2101 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(15): bicyclic nucleic acid (BNA)
gaagauggcauuuct

SEQ ID NO: 2102 - RNA, 21 nt, Artificial Sequence
  Description of Artificial Sequence: Synthetic Antisense oligonucleotide
  misc_feature (21)..(21): bicyclic nucleic acid (BNA)
ucaaggaagauggcauuucua

SEQ ID NO: 2103 - RNA, 19 nt, Artificial Sequence
  Description of Artificial Sequence: Synthetic Antisense oligonucleotide
  misc_feature (19)..(19): bicyclic nucleic acid (BNA)
ucaaggaagauggcauuuc

SEQ ID NO: 2104 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(18): bicyclic nucleic acid (BNA)
ucaaggaagauggcauut

SEQ ID NO: 2105 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(17): bicyclic nucleic acid (BNA)
ucaaggaagauggcaut

SEQ ID NO: 2106 - RNA, 15 nt, Artificial Sequence
  Description of Artificial Sequence: Synthetic Antisense oligonucleotide
  misc_feature (15)..(15): bicyclic nucleic acid (BNA)
ucaaggaagauggca

SEQ ID NO: 2107 - RNA, 14 nt, Artificial Sequence
  Description of Artificial Sequence: Synthetic Antisense oligonucleotide
  misc_feature (14)..(14): bicyclic nucleic acid (BNA)
ucaaggaagauggc

SEQ ID NO: 2108 - RNA, 13 nt, Artificial Sequence
  Description of Artificial Sequence: Synthetic Antisense oligonucleotide
  misc_feature (13)..(13): bicyclic nucleic acid (BNA)
ucaaggaagaugg

SEQ ID NO: 2109 - RNA, 12 nt, Artificial Sequence
  Description of Artificial Sequence: Synthetic Antisense oligonucleotide
  misc_feature (12)..(12): bicyclic nucleic acid (BNA)
ucaaggaagaug

SEQ ID NO: 2110 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): bicyclic nucleic acid (BNA)
ucaaggaagat

SEQ ID NO: 2111 - RNA, 10 nt, Artificial Sequence
  Description of Artificial Sequence: Synthetic Antisense oligonucleotide
  misc_feature (10)..(10): bicyclic nucleic acid (BNA)
ucaaggaaga

SEQ ID NO: 2112 - RNA, 9 nt, Artificial Sequence
  Description of Artificial Sequence: Synthetic Antisense oligonucleotide
  misc_feature (9)..(9): bicyclic nucleic acid (BNA)
ucaaggaag

SEQ ID NO: 2113 - RNA, 21 nt, Artificial Sequence
  Description of Artificial Sequence: Synthetic Antisense oligonucleotide
  misc_feature (21)..(21): bicyclic nucleic acid (BNA)
caaggaagauggcauuucuag

SEQ ID NO: 2114 - RNA, 20 nt, Artificial Sequence
  Description of Artificial Sequence: Synthetic Antisense oligonucleotide
  misc_feature (20)..(20): bicyclic nucleic acid (BNA)
caaggaagauggcauuucua

SEQ ID NO: 2115 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(19): bicyclic nucleic acid (BNA)
caaggaagauggcauuuct

SEQ ID NO: 2116 - RNA, 18 nt, Artificial Sequence
  Description of Artificial Sequence: Synthetic Antisense oligonucleotide
  misc_feature (18)..(18): bicyclic nucleic acid (BNA)
caaggaagauggcauuuc

SEQ ID NO: 2117 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(17): bicyclic nucleic acid (BNA)
caaggaagauggcauut

SEQ ID NO: 2118 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(16): bicyclic nucleic acid (BNA)
caaggaagauggcaut

SEQ ID NO: 2119 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(15): bicyclic nucleic acid (BNA)
caaggaagauggcat

SEQ ID NO: 2120 - RNA, 14 nt, Artificial Sequence
  Description of Artificial Sequence: Synthetic Antisense oligonucleotide
  misc_feature (14)..(14): bicyclic nucleic acid (BNA)
caaggaagauggca

SEQ ID NO: 2121 - RNA, 13 nt, Artificial Sequence
  Description of Artificial Sequence: Synthetic Antisense oligonucleotide
  misc_feature (13)..(13): bicyclic nucleic acid (BNA)
caaggaagauggc

SEQ ID NO: 2122 - RNA, 12 nt, Artificial Sequence
  Description of Artificial Sequence: Synthetic Antisense oligonucleotide
  misc_feature (12)..(12): bicyclic nucleic acid (BNA)
caaggaagaugg

SEQ ID NO: 2123 - RNA, 11 nt, Artificial Sequence
  Description of Artificial Sequence: Synthetic Antisense oligonucleotide
  misc_feature (11)..(11): bicyclic nucleic acid (BNA)
caaggaagaug

SEQ ID NO: 2124 - DNA, 10 bp, Artificial Sequence
  Description of Artificial Sequence: Synthetic Antisense oligonucleotide
  misc_feature (10)..(10): bicyclic nucleic acid (BNA)
caaggaagat

SEQ ID NO: 2125 - RNA, 9 nt, Artificial Sequence
  Description of Artificial Sequence: Synthetic Antisense oligonucleotide
  misc_feature (9)..(9): bicyclic nucleic acid (BNA)
caaggaaga

SEQ ID NO: 2126 - RNA, 8 nt, Artificial Sequence
  Description of Artificial Sequence: Synthetic Antisense oligonucleotide
  misc_feature (8)..(8): bicyclic nucleic acid (BNA)
caaggaag

SEQ ID NO: 2127 - RNA, 20 nt, Artificial Sequence
  Description of Artificial Sequence: Synthetic Antisense oligonucleotide
  misc_feature (20)..(20): bicyclic nucleic acid (BNA)
aaggaagauggcauuucuag

SEQ ID NO: 2128 - RNA, 19 nt, Artificial Sequence
  Description of Artificial Sequence: Synthetic Antisense oligonucleotide
  misc_feature (19)..(19): bicyclic nucleic acid (BNA)
aaggaagauggcauuucua

SEQ ID NO: 2129 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(18): bicyclic nucleic acid (BNA)
aaggaagauggcauuuct

SEQ ID NO: 2130 - RNA, 17 nt, Artificial Sequence
  Description of Artificial Sequence: Synthetic Antisense oligonucleotide
  misc_feature (17)..(17): bicyclic nucleic acid (BNA)
aaggaagauggcauuuc

SEQ ID NO: 2131 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(16): bicyclic nucleic acid (BNA)
aaggaagauggcauut

SEQ ID NO: 2132 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(15): bicyclic nucleic acid (BNA)
aaggaagauggcaut

SEQ ID NO: 2133 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(14): bicyclic nucleic acid (BNA)
aaggaagauggcat

SEQ ID NO: 2134 - RNA, 13 nt, Artificial Sequence
  Description of Artificial Sequence: Synthetic Antisense oligonucleotide
  misc_feature (13)..(13): bicyclic nucleic acid (BNA)
aaggaagauggca

SEQ ID NO: 2135 - RNA, 12 nt, Artificial Sequence
  Description of Artificial Sequence: Synthetic Antisense oligonucleotide
  misc_feature (12)..(12): bicyclic nucleic acid (BNA)
aaggaagauggc

SEQ ID NO: 2136 - RNA, 11 nt, Artificial Sequence
  Description of Artificial Sequence: Synthetic Antisense oligonucleotide
  misc_feature (11)..(11): bicyclic nucleic acid (BNA)
aaggaagaugg

SEQ ID NO: 2137 - RNA, 10 nt, Artificial Sequence
  Description of Artificial Sequence: Synthetic Antisense oligonucleotide
  misc_feature (10)..(10): bicyclic nucleic acid (BNA)
aaggaagaug

SEQ ID NO: 2138 - DNA, 9 bp, Artificial Sequence
  Description of Artificial Sequence: Synthetic Antisense oligonucleotide
  misc_feature (9)..(9): bicyclic nucleic acid (BNA)
aaggaagat

SEQ ID NO: 2139 - RNA, 8 nt, Artificial Sequence
  Description of Artificial Sequence: Synthetic Antisense oligonucleotide
  misc_feature (8)..(8): bicyclic nucleic acid (BNA)
aaggaaga

SEQ ID NO: 2140 - RNA, 19 nt, Artificial Sequence
  Description of Artificial Sequence: Synthetic Antisense oligonucleotide
  misc_feature (19)..(19): bicyclic nucleic acid (BNA)
aggaagauggcauuucuag

SEQ ID NO: 2141 - RNA, 18 nt, Artificial Sequence
  Description of Artificial Sequence: Synthetic Antisense oligonucleotide
  misc_feature (18)..(18): bicyclic nucleic acid (BNA)
aggaagauggcauuucua

SEQ ID NO: 2142 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(17): bicyclic nucleic acid (BNA)
aggaagauggcauuuct

SEQ ID NO: 2143 - RNA, 16 nt, Artificial Sequence
  Description of Artificial Sequence: Synthetic Antisense oligonucleotide
  misc_feature (16)..(16): bicyclic nucleic acid (BNA)
aggaagauggcauuuc

SEQ ID NO: 2144 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(15): bicyclic nucleic acid (BNA)
aggaagauggcauut

SEQ ID NO: 2145 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(14): bicyclic nucleic acid (BNA)
aggaagauggcaut

SEQ ID NO: 2146 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(13): bicyclic nucleic acid (BNA)
aggaagauggcat

SEQ ID NO: 2147 - RNA, 12 nt, Artificial Sequence
  Description of Artificial Sequence: Synthetic Antisense oligonucleotide
  misc_feature (12)..(12): bicyclic nucleic acid (BNA)
aggaagauggca

SEQ ID NO: 2148 - RNA, 10 nt, Artificial Sequence
  Description of Artificial Sequence: Synthetic Antisense oligonucleotide
  misc_feature (10)..(10): bicyclic nucleic acid (BNA)
aggaagaugg

SEQ ID NO: 2149 - RNA, 9 nt, Artificial Sequence
  Description of Artificial Sequence: Synthetic Antisense oligonucleotide
  misc_feature (9)..(9): bicyclic nucleic acid (BNA)
aggaagaug

SEQ ID NO: 2150 - DNA, 8 bp, Artificial Sequence
  Description of Artificial Sequence: Synthetic Antisense oligonucleotide
  misc_feature (8)..(8): bicyclic nucleic acid (BNA)
aggaagat

SEQ ID NO: 2151 - RNA, 18 nt, Artificial Sequence
  Description of Artificial Sequence: Synthetic Antisense oligonucleotide
  misc_feature (18)..(18): bicyclic nucleic acid (BNA)
ggaagauggcauuucuag

SEQ ID NO: 2152 - RNA, 17 nt, Artificial Sequence
  Description of Artificial Sequence: Synthetic Antisense oligonucleotide
  misc_feature (17)..(17): bicyclic nucleic acid (BNA)
ggaagauggcauuucua

SEQ ID NO: 2153 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(16): bicyclic nucleic acid (BNA)
ggaagauggcauuuct

SEQ ID NO: 2154 - RNA, 15 nt, Artificial Sequence
  Description of Artificial Sequence: Synthetic Antisense oligonucleotide
  misc_feature (15)..(15): bicyclic nucleic acid (BNA)
ggaagauggcauuuc

SEQ ID NO: 2155 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(14): bicyclic nucleic acid (BNA)
ggaagauggcauut

SEQ ID NO: 2156 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(13): bicyclic nucleic acid (BNA)
ggaagauggcaut

SEQ ID NO: 2157 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): bicyclic nucleic acid (BNA)
ggaagauggcat

SEQ ID NO: 2158 - RNA, 11 nt, Artificial Sequence
  Description of Artificial Sequence: Synthetic Antisense oligonucleotide
  misc_feature (11)..(11): bicyclic nucleic acid (BNA)
ggaagauggca

SEQ ID NO: 2159 - RNA, 10 nt, Artificial Sequence
  Description of Artificial Sequence: Synthetic Antisense oligonucleotide
  misc_feature (10)..(10): bicyclic nucleic acid (BNA)
ggaagauggc

SEQ ID NO: 2160 - RNA, 8 nt, Artificial Sequence
  Description of Artificial Sequence: Synthetic Antisense oligonucleotide
  misc_feature (8)..(8): bicyclic nucleic acid (BNA)
ggaagaug

SEQ ID NO: 2161 - RNA, 17 nt, Artificial Sequence
  Description of Artificial Sequence: Synthetic Antisense oligonucleotide
  misc_feature (17)..(17): bicyclic nucleic acid (BNA)
gaagauggcauuucuag

SEQ ID NO: 2162 - RNA, 16 nt, Artificial Sequence
  Description of Artificial Sequence: Synthetic Antisense oligonucleotide
  misc_feature (16)..(16): bicyclic nucleic acid (BNA)
gaagauggcauuucua

SEQ ID NO: 2163 - RNA, 14 nt, Artificial Sequence
  Description of Artificial Sequence: Synthetic Antisense oligonucleotide
  misc_feature (14)..(14): bicyclic nucleic acid (BNA)
gaagauggcauuuc

SEQ ID NO: 2164 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(13): bicyclic nucleic acid (BNA)
gaagauggcauut

SEQ ID NO: 2165 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): bicyclic nucleic acid (BNA)
gaagauggcaut

SEQ ID NO: 2166 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): bicyclic nucleic acid (BNA)
gaagauggcat

SEQ ID NO: 2167 - RNA, 10 nt, Artificial Sequence
  Description of Artificial Sequence: Synthetic Antisense oligonucleotide
  misc_feature (10)..(10): bicyclic nucleic acid (BNA)
gaagauggca

SEQ ID NO: 2168 - RNA, 9 nt, Artificial Sequence
  Description of Artificial Sequence: Synthetic Antisense oligonucleotide
  misc_feature (9)..(9): bicyclic nucleic acid (BNA)
gaagauggc

SEQ ID NO: 2169 - RNA, 8 nt, Artificial Sequence
  Description of Artificial Sequence: Synthetic Antisense oligonucleotide
  misc_feature (8)..(8): bicyclic nucleic acid (BNA)
gaagaugg

SEQ ID NO: 2170 - RNA, 16 nt, Artificial Sequence
  Description of Artificial Sequence: Synthetic Antisense oligonucleotide
  misc_feature (16)..(16): bicyclic nucleic acid (BNA)
aagauggcauuucuag

SEQ ID NO: 2171 - RNA, 15 nt, Artificial Sequence
  Description of Artificial Sequence: Synthetic Antisense oligonucleotide
  misc_feature (15)..(15): bicyclic nucleic acid (BNA)
aagauggcauuucua

SEQ ID NO: 2172 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(14): bicyclic nucleic acid (BNA)
aagauggcauuuct

SEQ ID NO: 2173 - RNA, 13 nt, Artificial Sequence
  Description of Artificial Sequence: Synthetic Antisense oligonucleotide
  misc_feature (13)..(13): bicyclic nucleic acid (BNA)
aagauggcauuuc

SEQ ID NO: 2174 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): bicyclic nucleic acid (BNA)
aagauggcauut

SEQ ID NO: 2175 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): bicyclic nucleic acid (BNA)
aagauggcaut

SEQ ID NO: 2176 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(10): bicyclic nucleic acid (BNA)
aagauggcat

SEQ ID NO: 2177 - RNA, 9 nt, Artificial Sequence
  Description of Artificial Sequence: Synthetic Antisense oligonucleotide
  misc_feature (9)..(9): bicyclic nucleic acid (BNA)
aagauggca

SEQ ID NO: 2178 - RNA, 8 nt, Artificial Sequence
  Description of Artificial Sequence: Synthetic Antisense oligonucleotide
  misc_feature (8)..(8): bicyclic nucleic acid (BNA)
aagauggc

SEQ ID NO: 2179 - RNA, 15 nt, Artificial Sequence
  Description of Artificial Sequence: Synthetic Antisense oligonucleotide
  misc_feature (15)..(15): bicyclic nucleic acid (BNA)
agauggcauuucuag

SEQ ID NO: 2180 - RNA, 14 nt, Artificial Sequence
  Description of Artificial Sequence: Synthetic Antisense oligonucleotide
  misc_feature (14)..(14): bicyclic nucleic acid (BNA)
agauggcauuucua

SEQ ID NO: 2181 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(13): bicyclic nucleic acid (BNA)
agauggcauuuct

SEQ ID NO: 2182 - RNA, 12 nt, Artificial Sequence
  Description of Artificial Sequence: Synthetic Antisense oligonucleotide
  misc_feature (12)..(12): bicyclic nucleic acid (BNA)
agauggcauuuc

SEQ ID NO: 2183 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): bicyclic nucleic acid (BNA)
agauggcauut

SEQ ID NO: 2184 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(10): bicyclic nucleic acid (BNA)
agauggcaut

SEQ ID NO: 2185 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): bicyclic nucleic acid (BNA)
agauggcat

SEQ ID NO: 2186 - RNA, 8 nt, Artificial Sequence
  Description of Artificial Sequence: Synthetic Antisense oligonucleotide
  misc_feature (8)..(8): bicyclic nucleic acid (BNA)
agauggca

SEQ ID NO: 2187 - RNA, 30 nt, Artificial Sequence; identical to SEQ ID NO: 287
  Description of Artificial Sequence: Synthetic Antisense oligonucleotide
  misc_feature (30)..(30): bicyclic nucleic acid (BNA)

SEQ ID NO: 2188 - RNA, 29 nt, Artificial Sequence
  Description of Artificial Sequence: Synthetic Antisense oligonucleotide
  misc_feature (29)..(29): bicyclic nucleic acid (BNA)
cuccaacaucaaggaagauggcauuucua

SEQ ID NO: 2189 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (28)..(28): bicyclic nucleic acid (BNA)
cuccaacaucaaggaagauggcauuuct

SEQ ID NO: 2190 - RNA, 27 nt, Artificial Sequence
  Description of Artificial Sequence: Synthetic Antisense oligonucleotide
  misc_feature (27)..(27): bicyclic nucleic acid (BNA)
cuccaacaucaaggaagauggcauuuc

SEQ ID NO: 2191 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (26)..(26): bicyclic nucleic acid (BNA)
cuccaacaucaaggaagauggcauut

SEQ ID NO: 2192 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (25)..(25): bicyclic nucleic acid (BNA)
cuccaacaucaaggaagauggcaut

SEQ ID NO: 2193 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (24)..(24): bicyclic nucleic acid (BNA)
cuccaacaucaaggaagauggcat

SEQ ID NO: 2194 - RNA, 23 nt, Artificial Sequence
  Description of Artificial Sequence: Synthetic Antisense oligonucleotide
  misc_feature (23)..(23): bicyclic nucleic acid (BNA)
cuccaacaucaaggaagauggca

SEQ ID NO: 2195 - RNA, 22 nt, Artificial Sequence
  Description of Artificial Sequence: Synthetic Antisense oligonucleotide
  misc_feature (22)..(22): bicyclic nucleic acid (BNA)
cuccaacaucaaggaagauggc

SEQ ID NO: 2196 - RNA, 21 nt, Artificial Sequence
  Description of Artificial Sequence: Synthetic Antisense oligonucleotide
  misc_feature (21)..(21): bicyclic nucleic acid (BNA)
cuccaacaucaaggaagaugg

SEQ ID NO: 2197 - RNA, 20 nt, Artificial Sequence
  Description of Artificial Sequence: Synthetic Antisense oligonucleotide
  misc_feature (20)..(20): bicyclic nucleic acid (BNA)
cuccaacaucaaggaagaug

SEQ ID NO: 2198 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(19): bicyclic nucleic acid (BNA)
cuccaacaucaaggaagat

SEQ ID NO: 2199 - RNA, 18 nt, Artificial Sequence
  Description of Artificial Sequence: Synthetic Antisense oligonucleotide
  misc_feature (18)..(18): bicyclic nucleic acid (BNA)
cuccaacaucaaggaaga

SEQ ID NO: 2200 - RNA, 17 nt, Artificial Sequence
  Description of Artificial Sequence: Synthetic Antisense oligonucleotide
  misc_feature (17)..(17): bicyclic nucleic acid (BNA)
cuccaacaucaaggaag

SEQ ID NO: 2201 - RNA, 29 nt, Artificial Sequence
  Description of Artificial Sequence: Synthetic Antisense oligonucleotide
  misc_feature (29)..(29): bicyclic nucleic acid (BNA)
uccaacaucaaggaagauggcauuucuag

SEQ ID NO: 2202 - RNA, 28 nt, Artificial Sequence
  Description of Artificial Sequence: Synthetic Antisense oligonucleotide
  misc_feature (28)..(28): bicyclic nucleic acid (BNA)
uccaacaucaaggaagauggcauuucua

SEQ ID NO: 2203 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (27)..(27): bicyclic nucleic acid (BNA)
uccaacaucaaggaagauggcauuuct

SEQ ID NO: 2204 - RNA, 26 nt, Artificial Sequence
  Description of Artificial Sequence: Synthetic Antisense oligonucleotide
  misc_feature (26)..(26): bicyclic nucleic acid (BNA)
uccaacaucaaggaagauggcauuuc

SEQ ID NO: 2205 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (25)..(25): bicyclic nucleic acid (BNA)
uccaacaucaaggaagauggcauut

SEQ ID NO: 2206 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (24)..(24): bicyclic nucleic acid (BNA)
uccaacaucaaggaagauggcaut

SEQ ID NO: 2207 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (23)..(23): bicyclic nucleic acid (BNA)
uccaacaucaaggaagauggcat

SEQ ID NO: 2208 - RNA, 22 nt, Artificial Sequence
  Description of Artificial Sequence: Synthetic Antisense oligonucleotide
  misc_feature (22)..(22): bicyclic nucleic acid (BNA)
uccaacaucaaggaagauggca

SEQ ID NO: 2209 - RNA, 21 nt, Artificial Sequence
  Description of Artificial Sequence: Synthetic Antisense oligonucleotide
  misc_feature (21)..(21): bicyclic nucleic acid (BNA)
uccaacaucaaggaagauggc

SEQ ID NO: 2210 - RNA, 20 nt, Artificial Sequence
  Description of Artificial Sequence: Synthetic Antisense oligonucleotide
  misc_feature (20)..(20): bicyclic nucleic acid (BNA)
uccaacaucaaggaagaugg

SEQ ID NO: 2211 - RNA, 19 nt, Artificial Sequence
  Description of Artificial Sequence: Synthetic Antisense oligonucleotide
  misc_feature (19)..(19): bicyclic nucleic acid (BNA)
uccaacaucaaggaagaug

SEQ ID NO: 2212 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(18): bicyclic nucleic acid (BNA)
uccaacaucaaggaagat

SEQ ID NO: 2213 - RNA, 17 nt, Artificial Sequence
  Description of Artificial Sequence: Synthetic Antisense oligonucleotide
  misc_feature (17)..(17): bicyclic nucleic acid (BNA)
uccaacaucaaggaaga

SEQ ID NO: 2214 - RNA, 16 nt, Artificial Sequence
  Description of Artificial Sequence: Synthetic Antisense oligonucleotide
  misc_feature (16)..(16): bicyclic nucleic acid (BNA)
uccaacaucaaggaag

SEQ ID NO: 2215 - RNA, 28 nt, Artificial Sequence
  Description of Artificial Sequence: Synthetic Antisense oligonucleotide
  misc_feature (28)..(28): bicyclic nucleic acid (BNA)
ccaacaucaaggaagauggcauuucuag

SEQ ID NO: 2216 - RNA, 27 nt, Artificial Sequence
  Description of Artificial Sequence: Synthetic Antisense oligonucleotide
  misc_feature (27)..(27): bicyclic nucleic acid (BNA)
ccaacaucaaggaagauggcauuucua

SEQ ID NO: 2217 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (26)..(26): bicyclic nucleic acid (BNA)
ccaacaucaaggaagauggcauuuct

SEQ ID NO: 2218 - RNA, 25 nt, Artificial Sequence
  Description of Artificial Sequence: Synthetic Antisense oligonucleotide
  misc_feature (25)..(25): bicyclic nucleic acid (BNA)
ccaacaucaaggaagauggcauuuc

SEQ ID NO: 2219 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (24)..(24): bicyclic nucleic acid (BNA)
ccaacaucaaggaagauggcauut

SEQ ID NO: 2220 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (23)..(23): bicyclic nucleic acid (BNA)
ccaacaucaaggaagauggcaut

SEQ ID NO: 2221 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (22)..(22): bicyclic nucleic acid (BNA)
ccaacaucaaggaagauggcat

SEQ ID NO: 2222 - RNA, 21 nt, Artificial Sequence
  Description of Artificial Sequence: Synthetic Antisense oligonucleotide
  misc_feature (21)..(21): bicyclic nucleic acid (BNA)
ccaacaucaaggaagauggca

SEQ ID NO: 2223 - RNA, 20 nt, Artificial Sequence
  Description of Artificial Sequence: Synthetic Antisense oligonucleotide
  misc_feature (20)..(20): bicyclic nucleic acid (BNA)
ccaacaucaaggaagauggc

SEQ ID NO: 2224 - RNA, 19 nt, Artificial Sequence
  Description of Artificial Sequence: Synthetic Antisense oligonucleotide
  misc_feature (19)..(19): bicyclic nucleic acid (BNA)
ccaacaucaaggaagaugg

SEQ ID NO: 2225 - RNA, 18 nt, Artificial Sequence
  Description of Artificial Sequence: Synthetic Antisense oligonucleotide
  misc_feature (18)..(18): bicyclic nucleic acid (BNA)
ccaacaucaaggaagaug

SEQ ID NO: 2226 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(17): bicyclic nucleic acid (BNA)
ccaacaucaaggaagat

SEQ ID NO: 2227 - RNA, 16 nt, Artificial Sequence
  Description of Artificial Sequence: Synthetic Antisense oligonucleotide
  misc_feature (16)..(16): bicyclic nucleic acid (BNA)
ccaacaucaaggaaga

SEQ ID NO: 2228 - RNA, 15 nt, Artificial Sequence
  Description of Artificial Sequence: Synthetic Antisense oligonucleotide
  misc_feature (15)..(15): bicyclic nucleic acid (BNA)
ccaacaucaaggaag

SEQ ID NO: 2229 - RNA, 27 nt, Artificial Sequence
  Description of Artificial Sequence: Synthetic Antisense oligonucleotide
  misc_feature (27)..(27): bicyclic nucleic acid (BNA)
caacaucaaggaagauggcauuucuag

SEQ ID NO: 2230 - RNA, 26 nt, Artificial Sequence
  Description of Artificial Sequence: Synthetic Antisense oligonucleotide
  misc_feature (26)..(26): bicyclic nucleic acid (BNA)
caacaucaaggaagauggcauuucua

SEQ ID NO: 2231 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (25)..(25): bicyclic nucleic acid (BNA)
caacaucaaggaagauggcauuuct

SEQ ID NO: 2232 - RNA, 24 nt, Artificial Sequence
  Description of Artificial Sequence: Synthetic Antisense oligonucleotide
  misc_feature (24)..(24): bicyclic nucleic acid (BNA)
caacaucaaggaagauggcauuuc

SEQ ID NO: 2233 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (23)..(23): bicyclic nucleic acid (BNA)
caacaucaaggaagauggcauut

SEQ ID NO: 2234 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (22)..(22): bicyclic nucleic acid (BNA)
caacaucaaggaagauggcaut

SEQ ID NO: 2235 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (21)..(21): bicyclic nucleic acid (BNA)
caacaucaaggaagauggcat

SEQ ID NO: 2236 - RNA, 20 nt, Artificial Sequence
  Description of Artificial Sequence: Synthetic Antisense oligonucleotide
  misc_feature (20)..(20): bicyclic nucleic acid (BNA)
caacaucaaggaagauggca

SEQ ID NO: 2237 - RNA, 19 nt, Artificial Sequence
  Description of Artificial Sequence: Synthetic Antisense oligonucleotide
  misc_feature (19)..(19): bicyclic nucleic acid (BNA)
caacaucaaggaagauggc

SEQ ID NO: 2238 - RNA, 18 nt, Artificial Sequence
  Description of Artificial Sequence: Synthetic Antisense oligonucleotide
  misc_feature (18)..(18): bicyclic nucleic acid (BNA)
caacaucaaggaagaugg

SEQ ID NO: 2239 - RNA, 17 nt, Artificial Sequence
  Description of Artificial Sequence: Synthetic Antisense oligonucleotide
  misc_feature (17)..(17): bicyclic nucleic acid (BNA)
caacaucaaggaagaug

SEQ ID NO: 2240 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(16): bicyclic nucleic acid (BNA)
caacaucaaggaagat

SEQ ID NO: 2241 - RNA, 15 nt, Artificial Sequence
  Description of Artificial Sequence: Synthetic Antisense oligonucleotide
  misc_feature (15)..(15): bicyclic nucleic acid (BNA)
caacaucaaggaaga

SEQ ID NO: 2242 - RNA, 14 nt, Artificial Sequence
  Description of Artificial Sequence: Synthetic Antisense oligonucleotide
  misc_feature (14)..(14): bicyclic nucleic acid (BNA)
caacaucaaggaag

SEQ ID NO: 2243 - RNA, 26 nt, Artificial Sequence
  Description of Artificial Sequence: Synthetic Antisense oligonucleotide
  misc_feature (26)..(26): bicyclic nucleic acid (BNA)
aacaucaaggaagauggcauuucuag

SEQ ID NO: 2244 - RNA, 25 nt, Artificial Sequence
  Description of Artificial Sequence: Synthetic Antisense oligonucleotide
  misc_feature (25)..(25): bicyclic nucleic acid (BNA)
aacaucaaggaagauggcauuucua

SEQ ID NO: 2245 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (24)..(24): bicyclic nucleic acid (BNA)
aacaucaaggaagauggcauuuct

SEQ ID NO: 2246 - RNA, 23 nt, Artificial Sequence
  Description of Artificial Sequence: Synthetic Antisense oligonucleotide
  misc_feature (23)..(23): bicyclic nucleic acid (BNA)
aacaucaaggaagauggcauuuc

SEQ ID NO: 2247 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (22)..(22): bicyclic nucleic acid (BNA)
aacaucaaggaagauggcauut

SEQ ID NO: 2248 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (21)..(21): bicyclic nucleic acid (BNA)
aacaucaaggaagauggcaut

SEQ ID NO: 2249 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (20)..(20): bicyclic nucleic acid (BNA)
aacaucaaggaagauggcat

SEQ ID NO: 2250 - RNA, 19 nt, Artificial Sequence
  Description of Artificial Sequence: Synthetic Antisense oligonucleotide
  misc_feature (19)..(19): bicyclic nucleic acid (BNA)
aacaucaaggaagauggca

SEQ ID NO: 2251 - RNA, 18 nt, Artificial Sequence
  Description of Artificial Sequence: Synthetic Antisense oligonucleotide
  misc_feature (18)..(18): bicyclic nucleic acid (BNA)
aacaucaaggaagauggc

SEQ ID NO: 2252 - RNA, 17 nt, Artificial Sequence
  Description of Artificial Sequence: Synthetic Antisense oligonucleotide
  misc_feature (17)..(17): bicyclic nucleic acid (BNA)
aacaucaaggaagaugg

SEQ ID NO: 2253 - RNA, 16 nt, Artificial Sequence
  Description of Artificial Sequence: Synthetic Antisense oligonucleotide
  misc_feature (16)..(16): bicyclic nucleic acid (BNA)
aacaucaaggaagaug

SEQ ID NO: 2254 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(15): bicyclic nucleic acid (BNA)
aacaucaaggaagat

SEQ ID NO: 2255 - RNA, 14 nt, Artificial Sequence
  Description of Artificial Sequence: Synthetic Antisense oligonucleotide
  misc_feature (14)..(14): bicyclic nucleic acid (BNA)
aacaucaaggaaga

SEQ ID NO: 2256 - RNA, 13 nt, Artificial Sequence
  Description of Artificial Sequence: Synthetic Antisense oligonucleotide
  misc_feature (13)..(13): bicyclic nucleic acid (BNA)
aacaucaaggaag

SEQ ID NO: 2257 - RNA, 25 nt, Artificial Sequence
  Description of Artificial Sequence: Synthetic Antisense oligonucleotide
  misc_feature (25)..(25): bicyclic nucleic acid (BNA)
acaucaaggaagauggcauuucuag

SEQ ID NO: 2258 - RNA, 24 nt, Artificial Sequence
  Description of Artificial Sequence: Synthetic Antisense oligonucleotide
  misc_feature (24)..(24): bicyclic nucleic acid (BNA)
acaucaaggaagauggcauuucua

SEQ ID NO: 2259 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (23)..(23): bicyclic nucleic acid (BNA)
acaucaaggaagauggcauuuct

SEQ ID NO: 2260 - RNA, 22 nt, Artificial Sequence
  Description of Artificial Sequence: Synthetic Antisense oligonucleotide
  misc_feature (22)..(22): bicyclic nucleic acid (BNA)
acaucaaggaagauggcauuuc

SEQ ID NO: 2261 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (21)..(21): bicyclic nucleic acid (BNA)
acaucaaggaagauggcauut

SEQ ID NO: 2262 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (20)..(20): bicyclic nucleic acid (BNA)
acaucaaggaagauggcaut

SEQ ID NO: 2263 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(19): bicyclic nucleic acid (BNA)
acaucaaggaagauggcat

SEQ ID NO: 2264 - RNA, 18 nt, Artificial Sequence
  Description of Artificial Sequence: Synthetic Antisense oligonucleotide
  misc_feature (18)..(18): bicyclic nucleic acid (BNA)
acaucaaggaagauggca

SEQ ID NO: 2265 - RNA, 17 nt, Artificial Sequence
  Description of Artificial Sequence: Synthetic Antisense oligonucleotide
  misc_feature (17)..(17): bicyclic nucleic acid (BNA)
acaucaaggaagauggc

SEQ ID NO: 2266 - RNA, 16 nt, Artificial Sequence
  Description of Artificial Sequence: Synthetic Antisense oligonucleotide
  misc_feature (16)..(16): bicyclic nucleic acid (BNA)
acaucaaggaagaugg

SEQ ID NO: 2267 - RNA, 15 nt, Artificial Sequence
  Description of Artificial Sequence: Synthetic Antisense oligonucleotide
  misc_feature (15)..(15): bicyclic nucleic acid (BNA)
acaucaaggaagaug

SEQ ID NO: 2268 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(14): bicyclic nucleic acid (BNA)
acaucaaggaagat

SEQ ID NO: 2269 - RNA, 13 nt, Artificial Sequence
  Description of Artificial Sequence: Synthetic Antisense oligonucleotide
  misc_feature (13)..(13): bicyclic nucleic acid (BNA)
acaucaaggaaga

SEQ ID NO: 2270 - RNA, 12 nt, Artificial Sequence
  Description of Artificial Sequence: Synthetic Antisense oligonucleotide
  misc_feature (12)..(12): bicyclic nucleic acid (BNA)
acaucaaggaag

SEQ ID NO: 2271 - RNA, 24 nt, Artificial Sequence
  Description of Artificial Sequence: Synthetic Antisense oligonucleotide
  misc_feature (24)..(24): bicyclic nucleic acid (BNA)
caucaaggaagauggcauuucuag

SEQ ID NO: 2272 - RNA, 23 nt, Artificial Sequence
  Description of Artificial Sequence: Synthetic Antisense oligonucleotide
  misc_feature (23)..(23): bicyclic nucleic acid (BNA)
caucaaggaagauggcauuucua

SEQ ID NO: 2273 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (22)..(22): bicyclic nucleic acid (BNA)
caucaaggaagauggcauuuct

SEQ ID NO: 2274 - RNA, 21 nt, Artificial Sequence
  Description of Artificial Sequence: Synthetic Antisense oligonucleotide
  misc_feature (21)..(21): bicyclic nucleic acid (BNA)
caucaaggaagauggcauuuc

SEQ ID NO: 2275 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (20)..(20): bicyclic nucleic acid (BNA)
caucaaggaagauggcauut

SEQ ID NO: 2276 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(19): bicyclic nucleic acid (BNA)
caucaaggaagauggcaut

SEQ ID NO: 2277 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(18): bicyclic nucleic acid (BNA)
caucaaggaagauggcat

SEQ ID NO: 2278 - RNA, 17 nt, Artificial Sequence
  Description of Artificial Sequence: Synthetic Antisense oligonucleotide
  misc_feature (17)..(17): bicyclic nucleic acid (BNA)
caucaaggaagauggca

SEQ ID NO: 2279 - RNA, 16 nt, Artificial Sequence
  Description of Artificial Sequence: Synthetic Antisense oligonucleotide
  misc_feature (16)..(16): bicyclic nucleic acid (BNA)
caucaaggaagauggc

SEQ ID NO: 2280 - RNA, 15 nt, Artificial Sequence
  Description of Artificial Sequence: Synthetic Antisense oligonucleotide
  misc_feature (15)..(15): bicyclic nucleic acid (BNA)
caucaaggaagaugg

SEQ ID NO: 2281 - RNA, 14 nt, Artificial Sequence
  Description of Artificial Sequence: Synthetic Antisense oligonucleotide
  misc_feature (14)..(14): bicyclic nucleic acid (BNA)
caucaaggaagaug

SEQ ID NO: 2282 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(13): bicyclic nucleic acid (BNA)
caucaaggaagat

SEQ ID NO: 2283 - RNA, 12 nt, Artificial Sequence
  Description of Artificial Sequence: Synthetic Antisense oligonucleotide
  misc_feature (12)..(12): bicyclic nucleic acid (BNA)
caucaaggaaga

SEQ ID NO: 2284 - RNA, 11 nt, Artificial Sequence
  Description of Artificial Sequence: Synthetic Antisense oligonucleotide
  misc_feature (11)..(11): bicyclic nucleic acid (BNA)
caucaaggaag

SEQ ID NO: 2285 - RNA, 23 nt, Artificial Sequence
  Description of Artificial Sequence: Synthetic Antisense oligonucleotide
  misc_feature (23)..(23): bicyclic nucleic acid (BNA)
aucaaggaagauggcauuucuag

SEQ ID NO: 2286 - RNA, 22 nt, Artificial Sequence
  Description of Artificial Sequence: Synthetic Antisense oligonucleotide
  misc_feature (22)..(22): bicyclic nucleic acid (BNA)
aucaaggaagauggcauuucua

SEQ ID NO: 2287 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (21)..(21): bicyclic nucleic acid (BNA)
aucaaggaagauggcauuuct

SEQ ID NO: 2288 - RNA, 20 nt, Artificial Sequence
  Description of Artificial Sequence: Synthetic Antisense oligonucleotide
  misc_feature (20)..(20): bicyclic nucleic acid (BNA)
aucaaggaagauggcauuuc

SEQ ID NO: 2289 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(19): bicyclic nucleic acid (BNA)
aucaaggaagauggcauut

SEQ ID NO: 2290 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(18): bicyclic nucleic acid (BNA)
aucaaggaagauggcaut

SEQ ID NO: 2291 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(17): bicyclic nucleic acid (BNA)
aucaaggaagauggcat

SEQ ID NO: 2292 - RNA, 16 nt, Artificial Sequence
  Description of Artificial Sequence: Synthetic Antisense oligonucleotide
  misc_feature (16)..(16): bicyclic nucleic acid (BNA)
aucaaggaagauggca

SEQ ID NO: 2293 - RNA, 15 nt, Artificial Sequence
  Description of Artificial Sequence: Synthetic Antisense oligonucleotide
  misc_feature (15)..(15): bicyclic nucleic acid (BNA)
aucaaggaagauggc

SEQ ID NO: 2294 - RNA, 14 nt, Artificial Sequence
  Description of Artificial Sequence: Synthetic Antisense oligonucleotide
  misc_feature (14)..(14): bicyclic nucleic acid (BNA)
aucaaggaagaugg

SEQ ID NO: 2295 - RNA, 13 nt, Artificial Sequence
  Description of Artificial Sequence: Synthetic Antisense oligonucleotide
  misc_feature (13)..(13): bicyclic nucleic acid (BNA)
aucaaggaagaug

SEQ ID NO: 2296 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): bicyclic nucleic acid (BNA)
aucaaggaagat

SEQ ID NO: 2297 - RNA, 11 nt, Artificial Sequence
  Description of Artificial Sequence: Synthetic Antisense oligonucleotide
  misc_feature (11)..(11): bicyclic nucleic acid (BNA)
aucaaggaaga

SEQ ID NO: 2298 - RNA, 10 nt, Artificial Sequence
  Description of Artificial Sequence: Synthetic Antisense oligonucleotide
  misc_feature (10)..(10): bicyclic nucleic acid (BNA)
aucaaggaag

SEQ ID NO: 2299 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
gguaaguucuguccaagc

SEQ ID NO: 2300 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
guaaguucuguccaagcc

SEQ ID NO: 2301 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
agucgguaaguucugucc

SEQ ID NO: 2302 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
cuguccaagcccgguuga

SEQ ID NO: 2303 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
taaguucuguccaag

SEQ ID NO: 2304 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
tucuguccaagcccgguuga

SEQ ID NO: 2305 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
tucuguccaagcccgguug

SEQ ID NO: 2306 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
tucuguccaagcccggut

SEQ ID NO: 2307 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
tucuguccaagcccggt

SEQ ID NO: 2308 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
tucuguccaagcccgg

SEQ ID NO: 2309 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
tucuguccaagcccg

SEQ ID NO: 2310 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
tucuguccaagccc

SEQ ID NO: 2311 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
tucuguccaagcc

SEQ ID NO: 2312 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
tucuguccaagc

SEQ ID NO: 2313 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
tucuguccaag

SEQ ID NO: 2314 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (10)..(10): bicyclic nucleic acid (BNA)
tucuguccaa

SEQ ID NO: 2315 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
tucugucca

SEQ ID NO: 2316 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (8)..(8): bicyclic nucleic acid (BNA)
tucugucc

SEQ ID NO: 2317 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
tcuguccaagcccgguuga

SEQ ID NO: 2318 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
tcuguccaagcccgguug

SEQ ID NO: 2319 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
tcuguccaagcccggut

SEQ ID NO: 2320 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
tcuguccaagcccggt

SEQ ID NO: 2321 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
tcuguccaagcccgg

SEQ ID NO: 2322 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
tcuguccaagcccg

SEQ ID NO: 2323 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
tcuguccaagccc

SEQ ID NO: 2324 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
tcuguccaagcc

SEQ ID NO: 2325 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
tcuguccaagc

SEQ ID NO: 2326 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (10)..(10): bicyclic nucleic acid (BNA)
tcuguccaag

SEQ ID NO: 2327 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
tcuguccaa

SEQ ID NO: 2328 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (8)..(8): bicyclic nucleic acid (BNA)
tcugucca

SEQ ID NO: 2329 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
cuguccaagcccgguug

SEQ ID NO: 2330 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
cuguccaagcccggut

SEQ ID NO: 2331 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
cuguccaagcccggt

SEQ ID NO: 2332 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
cuguccaagcccgg

SEQ ID NO: 2333 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
cuguccaagcccg

SEQ ID NO: 2334 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
cuguccaagccc

SEQ ID NO: 2335 - RNA, 11 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
cuguccaagcc

SEQ ID NO: 2336 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
cuguccaagc

SEQ ID NO: 2337 - RNA, 9 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
cuguccaag

SEQ ID NO: 2338 - RNA, 8 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
cuguccaa

SEQ ID NO: 2339 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
guucuguccaagcccgguug

SEQ ID NO: 2340 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
guucuguccaagcccggut

SEQ ID NO: 2341 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
guucuguccaagcccggt

SEQ ID NO: 2342 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
guucuguccaagcccgg

SEQ ID NO: 2343 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
guucuguccaagcccg

SEQ ID NO: 2344 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
guucuguccaagccc

SEQ ID NO: 2345 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
guucuguccaagcc

SEQ ID NO: 2346 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
guucuguccaagc

SEQ ID NO: 2347 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
guucuguccaag

SEQ ID NO: 2348 - RNA, 11 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
guucuguccaa

SEQ ID NO: 2349 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
guucugucca

SEQ ID NO: 2350 - RNA, 9 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
guucugucc

SEQ ID NO: 2351 - RNA, 8 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
guucuguc

SEQ ID NO: 2352 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
aguucuguccaagcccggut

SEQ ID NO: 2353 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
aguucuguccaagcccggt

SEQ ID NO: 2354 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
aguucuguccaagcccgg

SEQ ID NO: 2355 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
aguucuguccaagcccg

SEQ ID NO: 2356 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
aguucuguccaagccc

SEQ ID NO: 2357 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
aguucuguccaagcc

SEQ ID NO: 2358 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
aguucuguccaagc

SEQ ID NO: 2359 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
aguucuguccaag

SEQ ID NO: 2360 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
aguucuguccaa

SEQ ID NO: 2361 - RNA, 11 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
aguucugucca

SEQ ID NO: 2362 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
aguucugucc

SEQ ID NO: 2363 - RNA, 9 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
aguucuguc

SEQ ID NO: 2364 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (8)..(8): bicyclic nucleic acid (BNA)
aguucugt

SEQ ID NO: 2365 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
aaguucuguccaagcccggt

SEQ ID NO: 2366 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
aaguucuguccaagcccgg

SEQ ID NO: 2367 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
aaguucuguccaagcccg

SEQ ID NO: 2368 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
aaguucuguccaagccc

SEQ ID NO: 2369 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
aaguucuguccaagcc

SEQ ID NO: 2370 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
aaguucuguccaagc

SEQ ID NO: 2371 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
aaguucuguccaag

SEQ ID NO: 2372 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
aaguucuguccaa

SEQ ID NO: 2373 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
aaguucugucca

SEQ ID NO: 2374 - RNA, 11 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
aaguucugucc

SEQ ID NO: 2375 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
aaguucuguc

SEQ ID NO: 2376 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
aaguucugt

SEQ ID NO: 2377 - RNA, 8 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
aaguucug

SEQ ID NO: 2378 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
taaguucuguccaagcccgg

SEQ ID NO: 2379 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
taaguucuguccaagcccg

SEQ ID NO: 2380 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
taaguucuguccaagccc

SEQ ID NO: 2381 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
taaguucuguccaagcc

SEQ ID NO: 2382 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
taaguucuguccaagc

SEQ ID NO: 2383 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
taaguucuguccaa

SEQ ID NO: 2384 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
taaguucugucca

SEQ ID NO: 2385 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
taaguucugucc

SEQ ID NO: 2386 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
taaguucuguc

SEQ ID NO: 2387 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (10)..(10): bicyclic nucleic acid (BNA)
taaguucugt

SEQ ID NO: 2388 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
taaguucug

SEQ ID NO: 2389 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (8)..(8): bicyclic nucleic acid (BNA)
taaguuct

SEQ ID NO: 2390 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
guaaguucuguccaagcccg

SEQ ID NO: 2391 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
guaaguucuguccaagccc

SEQ ID NO: 2392 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
guaaguucuguccaagc

SEQ ID NO: 2393 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
guaaguucuguccaag

SEQ ID NO: 2394 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
guaaguucuguccaa

SEQ ID NO: 2395 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
guaaguucugucca

SEQ ID NO: 2396 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
guaaguucugucc

SEQ ID NO: 2397 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
guaaguucuguc

SEQ ID NO: 2398 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
guaaguucugt

SEQ ID NO: 2399 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
guaaguucug

SEQ ID NO: 2400 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
guaaguuct

SEQ ID NO: 2401 - RNA, 8 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
guaaguuc

SEQ ID NO: 2402 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
gguaaguucuguccaagccc

SEQ ID NO: 2403 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
gguaaguucuguccaagcc

SEQ ID NO: 2404 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
gguaaguucuguccaag

SEQ ID NO: 2405 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
gguaaguucuguccaa

SEQ ID NO: 2406 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
gguaaguucugucca

SEQ ID NO: 2407 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
gguaaguucugucc

SEQ ID NO: 2408 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
gguaaguucuguc

SEQ ID NO: 2409 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
gguaaguucugt

SEQ ID NO: 2410 - RNA, 11 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
gguaaguucug

SEQ ID NO: 2411 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (10)..(10): bicyclic nucleic acid (BNA)
gguaaguuct

SEQ ID NO: 2412 - RNA, 9 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
gguaaguuc

SEQ ID NO: 2413 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (8)..(8): bicyclic nucleic acid (BNA)
gguaagut

SEQ ID NO: 2414 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
cgguaaguucuguccaagcc

SEQ ID NO: 2415 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
cgguaaguucuguccaagc

SEQ ID NO: 2416 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
cgguaaguucuguccaag

SEQ ID NO: 2417 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
cgguaaguucuguccaa

SEQ ID NO: 2418 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
cgguaaguucugucca

SEQ ID NO: 2419 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
cgguaaguucugucc

SEQ ID NO: 2420 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
cgguaaguucuguc

SEQ ID NO: 2421 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
cgguaaguucugt

SEQ ID NO: 2422 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
cgguaaguucug

SEQ ID NO: 2423 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
cgguaaguuct

SEQ ID NO: 2424 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
cgguaaguuc

SEQ ID NO: 2425 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
cgguaagut

SEQ ID NO: 2426 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (8)..(8): bicyclic nucleic acid (BNA)
cgguaagt

SEQ ID NO: 2427 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
tcgguaaguucuguccaagc

SEQ ID NO: 2428 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
tcgguaaguucuguccaag

SEQ ID NO: 2429 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
tcgguaaguucuguccaa

SEQ ID NO: 2430 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
tcgguaaguucugucca

SEQ ID NO: 2431 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
tcgguaaguucugucc

SEQ ID NO: 2432 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
tcgguaaguucuguc

SEQ ID NO: 2433 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
tcgguaaguucugt

SEQ ID NO: 2434 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
tcgguaaguucug

SEQ ID NO: 2435 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
tcgguaaguuct

SEQ ID NO: 2436 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
tcgguaaguuc

SEQ ID NO: 2437 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (10)..(10): bicyclic nucleic acid (BNA)
tcgguaagut

SEQ ID NO: 2438 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
tcgguaagt

SEQ ID NO: 2439 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
gucgguaaguucuguccaag

SEQ ID NO: 2440 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
gucgguaaguucuguccaa

SEQ ID NO: 2441 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
gucgguaaguucugucca

SEQ ID NO: 2442 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
gucgguaaguucugucc

SEQ ID NO: 2443 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
gucgguaaguucuguc

SEQ ID NO: 2444 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
gucgguaaguucugt

SEQ ID NO: 2445 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
gucgguaaguucug

SEQ ID NO: 2446 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
gucgguaaguuct

SEQ ID NO: 2447 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
gucgguaaguuc

SEQ ID NO: 2448 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
gucgguaagut

SEQ ID NO: 2449 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (10)..(10): bicyclic nucleic acid (BNA)
gucgguaagt

SEQ ID NO: 2450 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
agucgguaaguucuguccaa

SEQ ID NO: 2451 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
agucgguaaguucugucca

SEQ ID NO: 2452 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
agucgguaaguucuguc

SEQ ID NO: 2453 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
agucgguaaguucugt

SEQ ID NO: 2454 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
agucgguaaguucug

SEQ ID NO: 2455 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
agucgguaaguuct

SEQ ID NO: 2456 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
agucgguaaguuc

SEQ ID NO: 2457 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
agucgguaagut

SEQ ID NO: 2458 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
agucgguaagt

SEQ ID NO: 2459 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
cagucgguaaguucugucca

SEQ ID NO: 2460 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
cagucgguaaguucugucc

SEQ ID NO: 2461 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
cagucgguaaguucuguc

SEQ ID NO: 2462 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
cagucgguaaguucugt

SEQ ID NO: 2463 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
cagucgguaaguucug

SEQ ID NO: 2464 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
cagucgguaaguuct

SEQ ID NO: 2465 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
cagucgguaaguuc

SEQ ID NO: 2466 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
cagucgguaagut

SEQ ID NO: 2467 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
cagucgguaagt

SEQ ID NO: 2468 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
ccagucgguaaguucugucc

SEQ ID NO: 2469 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
ccagucgguaaguucuguc

SEQ ID NO: 2470 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
ccagucgguaaguucugt

SEQ ID NO: 2471 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
ccagucgguaaguucug

SEQ ID NO: 2472 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
ccagucgguaaguuct

SEQ ID NO: 2473 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
ccagucgguaaguuc

SEQ ID NO: 2474 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
ccagucgguaagut

SEQ ID NO: 2475 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
ccagucgguaagt

SEQ ID NO: 2476 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
gccagucgguaaguucuguc

SEQ ID NO: 2477 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
gccagucgguaaguucugt

SEQ ID NO: 2478 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
gccagucgguaaguucug

SEQ ID NO: 2479 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
gccagucgguaaguuct

SEQ ID NO: 2480 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
gccagucgguaaguuc

SEQ ID NO: 2481 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
gccagucgguaagut

SEQ ID NO: 2482 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
gccagucgguaagt

SEQ ID NO: 2483 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
tcaaggaagauggcauuuct

SEQ ID NO: 2484 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (22)..(22): bicyclic nucleic acid (BNA)
tcaaggaagauggcauuucuag

SEQ ID NO: 2485 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
tcaaggaagauggcat

SEQ ID NO: 2486 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
gaagauggcauuuct

SEQ ID NO: 2487 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (21)..(21): bicyclic nucleic acid (BNA)
tcaaggaagauggcauuucua

SEQ ID NO: 2488 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
tcaaggaagauggcauuuc

SEQ ID NO: 2489 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
tcaaggaagauggcauut

SEQ ID NO: 2490 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
tcaaggaagauggcaut

SEQ ID NO: 2491 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
tcaaggaagauggca

SEQ ID NO: 2492 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
tcaaggaagauggc

SEQ ID NO: 2493 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
tcaaggaagaugg

SEQ ID NO: 2494 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
tcaaggaagaug

SEQ ID NO: 2495 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
tcaaggaagat

SEQ ID NO: 2496 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
tcaaggaaga

SEQ ID NO: 2497 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
tcaaggaag

SEQ ID NO: 2498 - RNA, 21 nt, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
caaggaagauggcauuucuag

SEQ ID NO: 2499 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
caaggaagauggcauuucua

SEQ ID NO: 2500 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
caaggaagauggcauuuct

SEQ ID NO: 2501 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
caaggaagauggcauuuc

SEQ ID NO: 2502 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
caaggaagauggcauut

SEQ ID NO: 2503 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
caaggaagauggcaut

SEQ ID NO: 2504 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
caaggaagauggcat

SEQ ID NO: 2505 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
caaggaagauggca

SEQ ID NO: 2506 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
caaggaagauggc

SEQ ID NO: 2507 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
caaggaagaugg

SEQ ID NO: 2508 - RNA, 11 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
caaggaagaug

SEQ ID NO: 2509 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
caaggaagat

SEQ ID NO: 2510 - RNA, 9 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
caaggaaga

SEQ ID NO: 2511 - RNA, 8 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
caaggaag

SEQ ID NO: 2512 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
aaggaagauggcauuucuag

SEQ ID NO: 2513 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
aaggaagauggcauuucua

SEQ ID NO: 2514 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
aaggaagauggcauuuct

SEQ ID NO: 2515 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
aaggaagauggcauuuc

SEQ ID NO: 2516 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
aaggaagauggcauut

SEQ ID NO: 2517 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
aaggaagauggcaut

SEQ ID NO: 2518 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
aaggaagauggcat

SEQ ID NO: 2519 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
aaggaagauggca

SEQ ID NO: 2520 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
aaggaagauggc

SEQ ID NO: 2521 - RNA, 11 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
aaggaagaugg

SEQ ID NO: 2522 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
aaggaagaug

SEQ ID NO: 2523 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
aaggaagat

SEQ ID NO: 2524 - RNA, 8 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
aaggaaga

SEQ ID NO: 2525 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
aggaagauggcauuucuag

SEQ ID NO: 2526 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
aggaagauggcauuucua

SEQ ID NO: 2527 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
aggaagauggcauuuct

SEQ ID NO: 2528 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
aggaagauggcauuuc

SEQ ID NO: 2529 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
aggaagauggcauut

SEQ ID NO: 2530 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
aggaagauggcaut

SEQ ID NO: 2531 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
aggaagauggcat

SEQ ID NO: 2532 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
aggaagauggca

SEQ ID NO: 2533 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
aggaagaugg

SEQ ID NO: 2534 - RNA, 9 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
aggaagaug

SEQ ID NO: 2535 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
aggaagat

SEQ ID NO: 2536 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
ggaagauggcauuucuag

SEQ ID NO: 2537 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
ggaagauggcauuucua

SEQ ID NO: 2538 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
ggaagauggcauuuct

SEQ ID NO: 2539 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
ggaagauggcauuuc

SEQ ID NO: 2540 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
ggaagauggcauut

SEQ ID NO: 2541 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
ggaagauggcaut

SEQ ID NO: 2542 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
ggaagauggcat

SEQ ID NO: 2543 - RNA, 11 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
ggaagauggca

SEQ ID NO: 2544 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
ggaagauggc

SEQ ID NO: 2545 - RNA, 8 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
ggaagaug

SEQ ID NO: 2546 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
gaagauggcauuucuag

SEQ ID NO: 2547 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
gaagauggcauuucua

SEQ ID NO: 2548 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
gaagauggcauuuc

SEQ ID NO: 2549 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
gaagauggcauut

SEQ ID NO: 2550 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
gaagauggcaut

SEQ ID NO: 2551 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
gaagauggcat

SEQ ID NO: 2552 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
gaagauggca

SEQ ID NO: 2553 - RNA, 9 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
gaagauggc

SEQ ID NO: 2554 - RNA, 8 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
gaagaugg

SEQ ID NO: 2555 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
aagauggcauuucuag

SEQ ID NO: 2556 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
aagauggcauuucua

SEQ ID NO: 2557 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
aagauggcauuuct

SEQ ID NO: 2558 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
aagauggcauuuc

SEQ ID NO: 2559 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
aagauggcauut

SEQ ID NO: 2560 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
aagauggcaut

SEQ ID NO: 2561 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (10)..(10): bicyclic nucleic acid (BNA)
aagauggcat

SEQ ID NO: 2562 - RNA, 9 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
aagauggca

SEQ ID NO: 2563 - RNA, 8 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
aagauggc

SEQ ID NO: 2564 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
agauggcauuucuag

SEQ ID NO: 2565 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
agauggcauuucua

SEQ ID NO: 2566 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
agauggcauuuct

SEQ ID NO: 2567 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
agauggcauuuc

SEQ ID NO: 2568 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
agauggcauut

SEQ ID NO: 2569 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (10)..(10): bicyclic nucleic acid (BNA)
agauggcaut

SEQ ID NO: 2570 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
agauggcat

SEQ ID NO: 2571 - RNA, 8 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
agauggca

SEQ ID NO: 2572 - RNA, 30 nt, Artificial Sequence; identical to SEQ ID NO: 287
  Description of Artificial Sequence: Synthetic Antisense oligonucleotide
  misc_feature (1)..(1): bicyclic nucleic acid (BNA)
  misc_feature (30)..(30): bicyclic nucleic acid (BNA)

SEQ ID NO: 2573 - RNA, 29 nt, Artificial Sequence
  Description of Artificial Sequence: Synthetic Antisense oligonucleotide
  misc_feature (1)..(1): bicyclic nucleic acid (BNA)
  misc_feature (29)..(29): bicyclic nucleic acid (BNA)
cuccaacaucaaggaagauggcauuucua

SEQ ID NO: 2574 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (28)..(28): bicyclic nucleic acid (BNA)
cuccaacaucaaggaagauggcauuuct

SEQ ID NO: 2575 - RNA, 27 nt, Artificial Sequence
  Description of Artificial Sequence: Synthetic Antisense oligonucleotide
  misc_feature (1)..(1): bicyclic nucleic acid (BNA)
  misc_feature (27)..(27): bicyclic nucleic acid (BNA)
cuccaacaucaaggaagauggcauuuc

SEQ ID NO: 2576 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (26)..(26): bicyclic nucleic acid (BNA)
cuccaacaucaaggaagauggcauut

SEQ ID NO: 2577 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (25)..(25): bicyclic nucleic acid (BNA)
cuccaacaucaaggaagauggcaut

SEQ ID NO: 2578 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (24)..(24): bicyclic nucleic acid (BNA)
cuccaacaucaaggaagauggcat

SEQ ID NO: 2579 - RNA, 23 nt, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
cuccaacaucaaggaagauggca

SEQ ID NO: 2580 - RNA, 22 nt, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
cuccaacaucaaggaagauggc

SEQ ID NO: 2581 - RNA, 21 nt, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
cuccaacaucaaggaagaugg

SEQ ID NO: 2582 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
cuccaacaucaaggaagaug

SEQ ID NO: 2583 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
cuccaacaucaaggaagat

SEQ ID NO: 2584 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
cuccaacaucaaggaaga

SEQ ID NO: 2585 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
cuccaacaucaaggaag

SEQ ID NO: 2586 - DNA, 29 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (29)..(29): bicyclic nucleic acid (BNA)
tccaacaucaaggaagauggcauuucuag

SEQ ID NO: 2587 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (28)..(28): bicyclic nucleic acid (BNA)
tccaacaucaaggaagauggcauuucua

SEQ ID NO: 2588 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (27)..(27): bicyclic nucleic acid (BNA)
tccaacaucaaggaagauggcauuuct

SEQ ID NO: 2589 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (26)..(26): bicyclic nucleic acid (BNA)
tccaacaucaaggaagauggcauuuc

SEQ ID NO: 2590 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (25)..(25): bicyclic nucleic acid (BNA)
tccaacaucaaggaagauggcauut

SEQ ID NO: 2591 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (24)..(24): bicyclic nucleic acid (BNA)
tccaacaucaaggaagauggcaut

SEQ ID NO: 2592 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (23)..(23): bicyclic nucleic acid (BNA)
tccaacaucaaggaagauggcat

SEQ ID NO: 2593 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (22)..(22): bicyclic nucleic acid (BNA)
tccaacaucaaggaagauggca

SEQ ID NO: 2594 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (21)..(21): bicyclic nucleic acid (BNA)
tccaacaucaaggaagauggc

SEQ ID NO: 2595 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
tccaacaucaaggaagaugg

SEQ ID NO: 2596 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
tccaacaucaaggaagaug

SEQ ID NO: 2597 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
tccaacaucaaggaagat

SEQ ID NO: 2598 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
tccaacaucaaggaaga

SEQ ID NO: 2599 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
tccaacaucaaggaag

SEQ ID NO: 2600 - RNA, 28 nt, Artificial Sequence
  Description of Artificial Sequence: Synthetic Antisense oligonucleotide
  misc_feature (1)..(1): bicyclic nucleic acid (BNA)
  misc_feature (28)..(28): bicyclic nucleic acid (BNA)
ccaacaucaaggaagauggcauuucuag

SEQ ID NO: 2601 - RNA, 27 nt, Artificial Sequence
  Description of Artificial Sequence: Synthetic Antisense oligonucleotide
  misc_feature (1)..(1): bicyclic nucleic acid (BNA)
  misc_feature (27)..(27): bicyclic nucleic acid (BNA)
ccaacaucaaggaagauggcauuucua

SEQ ID NO: 2602 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (26)..(26): bicyclic nucleic acid (BNA)
ccaacaucaaggaagauggcauuuct

SEQ ID NO: 2603 - RNA, 25 nt, Artificial Sequence
  Description of Artificial Sequence: Synthetic Antisense oligonucleotide
  misc_feature (1)..(1): bicyclic nucleic acid (BNA)
  misc_feature (25)..(25): bicyclic nucleic acid (BNA)
ccaacaucaaggaagauggcauuuc

SEQ ID NO: 2604 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (24)..(24): bicyclic nucleic acid (BNA)
ccaacaucaaggaagauggcauut

SEQ ID NO: 2605 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (23)..(23): bicyclic nucleic acid (BNA)
ccaacaucaaggaagauggcaut

SEQ ID NO: 2606 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (22)..(22): bicyclic nucleic acid (BNA)
ccaacaucaaggaagauggcat

SEQ ID NO: 2607 - RNA, 21 nt, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
ccaacaucaaggaagauggca

SEQ ID NO: 2608 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
ccaacaucaaggaagauggc

SEQ ID NO: 2609 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
ccaacaucaaggaagaugg

SEQ ID NO: 2610 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
ccaacaucaaggaagaug

SEQ ID NO: 2611 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
ccaacaucaaggaagat

SEQ ID NO: 2612 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
ccaacaucaaggaaga

SEQ ID NO: 2613 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
ccaacaucaaggaag

SEQ ID NO: 2614 - RNA, 27 nt, Artificial Sequence
  Description of Artificial Sequence: Synthetic Antisense oligonucleotide
  misc_feature (1)..(1): bicyclic nucleic acid (BNA)
  misc_feature (27)..(27): bicyclic nucleic acid (BNA)
caacaucaaggaagauggcauuucuag

SEQ ID NO: 2615 - RNA, 26 nt, Artificial Sequence
  Description of Artificial Sequence: Synthetic Antisense oligonucleotide
  misc_feature (1)..(1): bicyclic nucleic acid (BNA)
  misc_feature (26)..(26): bicyclic nucleic acid (BNA)
caacaucaaggaagauggcauuucua

SEQ ID NO: 2616 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (25)..(25): bicyclic nucleic acid (BNA)
caacaucaaggaagauggcauuuct

SEQ ID NO: 2617 - RNA, 24 nt, Artificial Sequence
  Description of Artificial Sequence: Synthetic Antisense oligonucleotide
  misc_feature (1)..(1): bicyclic nucleic acid (BNA)
  misc_feature (24)..(24): bicyclic nucleic acid (BNA)
caacaucaaggaagauggcauuuc

SEQ ID NO: 2618 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (23)..(23): bicyclic nucleic acid (BNA)
caacaucaaggaagauggcauut

SEQ ID NO: 2619 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (22)..(22): bicyclic nucleic acid (BNA)
caacaucaaggaagauggcaut

SEQ ID NO: 2620 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (21)..(21): bicyclic nucleic acid (BNA)
caacaucaaggaagauggcat

SEQ ID NO: 2621 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
caacaucaaggaagauggca

SEQ ID NO: 2622 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
caacaucaaggaagauggc

SEQ ID NO: 2623 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
caacaucaaggaagaugg

SEQ ID NO: 2624 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
caacaucaaggaagaug

SEQ ID NO: 2625 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
caacaucaaggaagat

SEQ ID NO: 2626 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
caacaucaaggaaga

SEQ ID NO: 2627 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
caacaucaaggaag

SEQ ID NO: 2628 - RNA, 26 nt, Artificial Sequence
  Description of Artificial Sequence: Synthetic Antisense oligonucleotide
  misc_feature (1)..(1): bicyclic nucleic acid (BNA)
  misc_feature (26)..(26): bicyclic nucleic acid (BNA)
aacaucaaggaagauggcauuucuag

SEQ ID NO: 2629 - RNA, 25 nt, Artificial Sequence
  Description of Artificial Sequence: Synthetic Antisense oligonucleotide
  misc_feature (1)..(1): bicyclic nucleic acid (BNA)
  misc_feature (25)..(25): bicyclic nucleic acid (BNA)
aacaucaaggaagauggcauuucua

SEQ ID NO: 2630 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (24)..(24): bicyclic nucleic acid (BNA)
aacaucaaggaagauggcauuuct

SEQ ID NO: 2631 - RNA, 23 nt, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
aacaucaaggaagauggcauuuc

SEQ ID NO: 2632 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (22)..(22): bicyclic nucleic acid (BNA)
aacaucaaggaagauggcauut

SEQ ID NO: 2633 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (21)..(21): bicyclic nucleic acid (BNA)
aacaucaaggaagauggcaut

SEQ ID NO: 2634 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
aacaucaaggaagauggcat

SEQ ID NO: 2635 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
aacaucaaggaagauggca

SEQ ID NO: 2636 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
aacaucaaggaagauggc

SEQ ID NO: 2637 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
aacaucaaggaagaugg

SEQ ID NO: 2638 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
aacaucaaggaagaug

SEQ ID NO: 2639 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
aacaucaaggaagat

SEQ ID NO: 2640 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
aacaucaaggaaga

SEQ ID NO: 2641 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
aacaucaaggaag

SEQ ID NO: 2642 - RNA, 25 nt, Artificial Sequence
  Description of Artificial Sequence: Synthetic Antisense oligonucleotide
  misc_feature (1)..(1): bicyclic nucleic acid (BNA)
  misc_feature (25)..(25): bicyclic nucleic acid (BNA)
acaucaaggaagauggcauuucuag

SEQ ID NO: 2643 - RNA, 24 nt, Artificial Sequence
  Description of Artificial Sequence: Synthetic Antisense oligonucleotide
  misc_feature (1)..(1): bicyclic nucleic acid (BNA)
  misc_feature (24)..(24): bicyclic nucleic acid (BNA)
acaucaaggaagauggcauuucua

SEQ ID NO: 2644 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (23)..(23): bicyclic nucleic acid (BNA)
acaucaaggaagauggcauuuct

SEQ ID NO: 2645 - RNA, 22 nt, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
acaucaaggaagauggcauuuc

SEQ ID NO: 2646 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (21)..(21): bicyclic nucleic acid (BNA)
acaucaaggaagauggcauut

SEQ ID NO: 2647 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
acaucaaggaagauggcaut

SEQ ID NO: 2648 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
acaucaaggaagauggcat

SEQ ID NO: 2649 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
acaucaaggaagauggca

SEQ ID NO: 2650 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
acaucaaggaagauggc

SEQ ID NO: 2651 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
acaucaaggaagaugg

SEQ ID NO: 2652 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
acaucaaggaagaug

SEQ ID NO: 2653 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
acaucaaggaagat

SEQ ID NO: 2654 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
acaucaaggaaga

SEQ ID NO: 2655 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
acaucaaggaag

SEQ ID NO: 2656 - RNA, 24 nt, Artificial Sequence
  Description of Artificial Sequence: Synthetic Antisense oligonucleotide
  misc_feature (1)..(1): bicyclic nucleic acid (BNA)
  misc_feature (24)..(24): bicyclic nucleic acid (BNA)
caucaaggaagauggcauuucuag

SEQ ID NO: 2657 - RNA, 23 nt, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
caucaaggaagauggcauuucua

SEQ ID NO: 2658 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (22)..(22): bicyclic nucleic acid (BNA)
caucaaggaagauggcauuuct

SEQ ID NO: 2659 - RNA, 21 nt, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
caucaaggaagauggcauuuc

SEQ ID NO: 2660 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
caucaaggaagauggcauut

SEQ ID NO: 2661 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
caucaaggaagauggcaut

SEQ ID NO: 2662 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
caucaaggaagauggcat

SEQ ID NO: 2663 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
caucaaggaagauggca

SEQ ID NO: 2664 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
caucaaggaagauggc

SEQ ID NO: 2665 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
caucaaggaagaugg

SEQ ID NO: 2666 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
caucaaggaagaug

SEQ ID NO: 2667 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
caucaaggaagat

SEQ ID NO: 2668 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
caucaaggaaga

SEQ ID NO: 2669 - RNA, 11 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
caucaaggaag

SEQ ID NO: 2670 - RNA, 23 nt, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
aucaaggaagauggcauuucuag

SEQ ID NO: 2671 - RNA, 22 nt, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
aucaaggaagauggcauuucua

SEQ ID NO: 2672 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (21)..(21): bicyclic nucleic acid (BNA)
aucaaggaagauggcauuuct

SEQ ID NO: 2673 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
aucaaggaagauggcauuuc

SEQ ID NO: 2674 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
aucaaggaagauggcauut

SEQ ID NO: 2675 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
aucaaggaagauggcaut

SEQ ID NO: 2676 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
aucaaggaagauggcat

SEQ ID NO: 2677 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
aucaaggaagauggca

SEQ ID NO: 2678 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
aucaaggaagauggc

SEQ ID NO: 2679 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
aucaaggaagaugg

SEQ ID NO: 2680 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
aucaaggaagaug

SEQ ID NO: 2681 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
aucaaggaagat

SEQ ID NO: 2682 - RNA, 11 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
aucaaggaaga

SEQ ID NO: 2683 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
aucaaggaag

SEQ ID NO: 2684 - RNA, 18 nt, Artificial Sequence
  Description of Artificial Sequence: Synthetic Antisense oligonucleotide
  misc_feature (1)..(2): bicyclic nucleic acid (BNA)
gguaaguucuguccaagc

SEQ ID NO: 2685 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtaaguucuguccaagcc

SEQ ID NO: 2686 - RNA, 18 nt, Artificial Sequence
  Description of Artificial Sequence: Synthetic Antisense oligonucleotide
  misc_feature (1)..(2): bicyclic nucleic acid (BNA)
agucgguaaguucugucc

SEQ ID NO: 2687 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctguccaagcccgguuga

SEQ ID NO: 2688 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
taaguucuguccaag

SEQ ID NO: 2689 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ttcuguccaagcccgguuga

SEQ ID NO: 2690 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ttcuguccaagcccgguug

SEQ ID NO: 2691 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ttcuguccaagcccgguu

SEQ ID NO: 2692 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ttcuguccaagcccggu

SEQ ID NO: 2693 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ttcuguccaagcccgg

SEQ ID NO: 2694 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ttcuguccaagcccg

SEQ ID NO: 2695 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ttcuguccaagccc

SEQ ID NO: 2696 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ttcuguccaagcc

SEQ ID NO: 2697 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ttcuguccaagc

SEQ ID NO: 2698 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ttcuguccaag

SEQ ID NO: 2699 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ttcuguccaa

SEQ ID NO: 2700 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ttcugucca

SEQ ID NO: 2701 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ttcugucc

SEQ ID NO: 2702 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcuguccaagcccgguuga

SEQ ID NO: 2703 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcuguccaagcccgguug

SEQ ID NO: 2704 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcuguccaagcccgguu

SEQ ID NO: 2705 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcuguccaagcccggu

SEQ ID NO: 2706 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcuguccaagcccgg

SEQ ID NO: 2707 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcuguccaagcccg

SEQ ID NO: 2708 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcuguccaagccc

SEQ ID NO: 2709 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcuguccaagcc

SEQ ID NO: 2710 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcuguccaagc

SEQ ID NO: 2711 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcuguccaag

SEQ ID NO: 2712 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcuguccaa

SEQ ID NO: 2713 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcugucca

SEQ ID NO: 2714 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctguccaagcccgguug

SEQ ID NO: 2715 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctguccaagcccgguu

SEQ ID NO: 2716 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctguccaagcccggu

SEQ ID NO: 2717 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctguccaagcccgg

SEQ ID NO: 2718 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctguccaagcccg

SEQ ID NO: 2719 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctguccaagccc

SEQ ID NO: 2720 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctguccaagcc

SEQ ID NO: 2721 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctguccaagc

SEQ ID NO: 2722 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctguccaag

SEQ ID NO: 2723 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctguccaa

SEQ ID NO: 2724 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtucuguccaagcccgguug

SEQ ID NO: 2725 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtucuguccaagcccgguu

SEQ ID NO: 2726 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtucuguccaagcccggu

SEQ ID NO: 2727 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtucuguccaagcccgg

SEQ ID NO: 2728 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtucuguccaagcccg

SEQ ID NO: 2729 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtucuguccaagccc

SEQ ID NO: 2730 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtucuguccaagcc

SEQ ID NO: 2731 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtucuguccaagc

SEQ ID NO: 2732 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtucuguccaag

SEQ ID NO: 2733 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtucuguccaa

SEQ ID NO: 2734 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtucugucca

SEQ ID NO: 2735 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtucugucc

SEQ ID NO: 2736 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtucuguc

SEQ ID NO: 2737 - RNA, 20 nt, Artificial Sequence
  Description of Artificial Sequence: Synthetic Antisense oligonucleotide
  misc_feature (1)..(2): bicyclic nucleic acid (BNA)
aguucuguccaagcccgguu

SEQ ID NO: 2738 - RNA, 19 nt, Artificial Sequence
  Description of Artificial Sequence: Synthetic Antisense oligonucleotide
  misc_feature (1)..(2): bicyclic nucleic acid (BNA)
aguucuguccaagcccggu

SEQ ID NO: 2739 - RNA, 18 nt, Artificial Sequence
  Description of Artificial Sequence: Synthetic Antisense oligonucleotide
  misc_feature (1)..(2): bicyclic nucleic acid (BNA)
aguucuguccaagcccgg

SEQ ID NO: 2740 - RNA, 17 nt, Artificial Sequence
  Description of Artificial Sequence: Synthetic Antisense oligonucleotide
  misc_feature (1)..(2): bicyclic nucleic acid (BNA)
aguucuguccaagcccg

SEQ ID NO: 2741 - RNA, 16 nt, Artificial Sequence
  Description of Artificial Sequence: Synthetic Antisense oligonucleotide
  misc_feature (1)..(2): bicyclic nucleic acid (BNA)
aguucuguccaagccc

SEQ ID NO: 2742 - RNA, 15 nt, Artificial Sequence
  Description of Artificial Sequence: Synthetic Antisense oligonucleotide
  misc_feature (1)..(2): bicyclic nucleic acid (BNA)
aguucuguccaagcc

SEQ ID NO: 2743 - RNA, 14 nt, Artificial Sequence
  Description of Artificial Sequence: Synthetic Antisense oligonucleotide
  misc_feature (1)..(2): bicyclic nucleic acid (BNA)
aguucuguccaagc

SEQ ID NO: 2744 - RNA, 13 nt, Artificial Sequence
  Description of Artificial Sequence: Synthetic Antisense oligonucleotide
  misc_feature (1)..(2): bicyclic nucleic acid (BNA)
aguucuguccaag

SEQ ID NO: 2745 - RNA, 12 nt, Artificial Sequence
  Description of Artificial Sequence: Synthetic Antisense oligonucleotide
  misc_feature (1)..(2): bicyclic nucleic acid (BNA)
aguucuguccaa

SEQ ID NO: 2746 - RNA, 11 nt, Artificial Sequence
  Description of Artificial Sequence: Synthetic Antisense oligonucleotide
  misc_feature (1)..(2): bicyclic nucleic acid (BNA)
aguucugucca

SEQ ID NO: 2747 - RNA, 10 nt, Artificial Sequence
  Description of Artificial Sequence: Synthetic Antisense oligonucleotide
  misc_feature (1)..(2): bicyclic nucleic acid (BNA)
aguucugucc

SEQ ID NO: 2748 - RNA, 9 nt, Artificial Sequence
  Description of Artificial Sequence: Synthetic Antisense oligonucleotide
  misc_feature (1)..(2): bicyclic nucleic acid (BNA)
aguucuguc

SEQ ID NO: 2749 - RNA, 8 nt, Artificial Sequence
  Description of Artificial Sequence: Synthetic Antisense oligonucleotide
  misc_feature (1)..(2): bicyclic nucleic acid (BNA)
aguucugu

SEQ ID NO: 2750 - RNA, 20 nt, Artificial Sequence
  Description of Artificial Sequence: Synthetic Antisense oligonucleotide
  misc_feature (1)..(2): bicyclic nucleic acid (BNA)
aaguucuguccaagcccggu

SEQ ID NO: 2751 - RNA, 19 nt, Artificial Sequence
  Description of Artificial Sequence: Synthetic Antisense oligonucleotide
  misc_feature (1)..(2): bicyclic nucleic acid (BNA)
aaguucuguccaagcccgg

SEQ ID NO: 2752 - RNA, 18 nt, Artificial Sequence
  Description of Artificial Sequence: Synthetic Antisense oligonucleotide
  misc_feature (1)..(2): bicyclic nucleic acid (BNA)
aaguucuguccaagcccg

SEQ ID NO: 2753 - RNA, 17 nt, Artificial Sequence
  Description of Artificial Sequence: Synthetic Antisense oligonucleotide
  misc_feature (1)..(2): bicyclic nucleic acid (BNA)
aaguucuguccaagccc

SEQ ID NO: 2754 - RNA, 16 nt, Artificial Sequence
  Description of Artificial Sequence: Synthetic Antisense oligonucleotide
  misc_feature (1)..(2): bicyclic nucleic acid (BNA)
aaguucuguccaagcc

SEQ ID NO: 2755 - RNA, 15 nt, Artificial Sequence
  Description of Artificial Sequence: Synthetic Antisense oligonucleotide
  misc_feature (1)..(2): bicyclic nucleic acid (BNA)
aaguucuguccaagc

SEQ ID NO: 2756 - RNA, 14 nt, Artificial Sequence
  Description of Artificial Sequence: Synthetic Antisense oligonucleotide
  misc_feature (1)..(2): bicyclic nucleic acid (BNA)
aaguucuguccaag

SEQ ID NO: 2757 - RNA, 13 nt, Artificial Sequence
  Description of Artificial Sequence: Synthetic Antisense oligonucleotide
  misc_feature (1)..(2): bicyclic nucleic acid (BNA)
aaguucuguccaa

SEQ ID NO: 2758 - RNA, 12 nt, Artificial Sequence
  Description of Artificial Sequence: Synthetic Antisense oligonucleotide
  misc_feature (1)..(2): bicyclic nucleic acid (BNA)
aaguucugucca

SEQ ID NO: 2759 - RNA, 11 nt, Artificial Sequence
  Description of Artificial Sequence: Synthetic Antisense oligonucleotide
  misc_feature (1)..(2): bicyclic nucleic acid (BNA)
aaguucugucc

SEQ ID NO: 2760 - RNA, 10 nt, Artificial Sequence
  Description of Artificial Sequence: Synthetic Antisense oligonucleotide
  misc_feature (1)..(2): bicyclic nucleic acid (BNA)
aaguucuguc

SEQ ID NO: 2761 - RNA, 9 nt, Artificial Sequence
  Description of Artificial Sequence: Synthetic Antisense oligonucleotide
  misc_feature (1)..(2): bicyclic nucleic acid (BNA)
aaguucugu

SEQ ID NO: 2762 - RNA, 8 nt, Artificial Sequence
  Description of Artificial Sequence: Synthetic Antisense oligonucleotide
  misc_feature (1)..(2): bicyclic nucleic acid (BNA)
aaguucug

SEQ ID NO: 2763 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
taaguucuguccaagcccgg

SEQ ID NO: 2764 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
taaguucuguccaagcccg

SEQ ID NO: 2765 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
taaguucuguccaagccc

SEQ ID NO: 2766 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
taaguucuguccaagcc

SEQ ID NO: 2767 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
taaguucuguccaagc

SEQ ID NO: 2768 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
taaguucuguccaa

SEQ ID NO: 2769 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
taaguucugucca

SEQ ID NO: 2770 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
taaguucugucc

SEQ ID NO: 2771 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
taaguucuguc

SEQ ID NO: 2772 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
taaguucugu

SEQ ID NO: 2773 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
taaguucug

SEQ ID NO: 2774 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
taaguucu

SEQ ID NO: 2775 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtaaguucuguccaagcccg

SEQ ID NO: 2776 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtaaguucuguccaagccc

SEQ ID NO: 2777 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtaaguucuguccaagc

SEQ ID NO: 2778 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtaaguucuguccaag

SEQ ID NO: 2779 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtaaguucuguccaa

SEQ ID NO: 2780 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtaaguucugucca

SEQ ID NO: 2781 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtaaguucugucc

SEQ ID NO: 2782 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtaaguucuguc

SEQ ID NO: 2783 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtaaguucugu

SEQ ID NO: 2784 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtaaguucug

SEQ ID NO: 2785 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtaaguucu

SEQ ID NO: 2786 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtaaguuc

SEQ ID NO: 2787 - RNA, 20 nt, Artificial Sequence
  Description of Artificial Sequence: Synthetic Antisense oligonucleotide
  misc_feature (1)..(2): bicyclic nucleic acid (BNA)
gguaaguucuguccaagccc

SEQ ID NO: 2788 - RNA, 19 nt, Artificial Sequence
  Description of Artificial Sequence: Synthetic Antisense oligonucleotide
  misc_feature (1)..(2): bicyclic nucleic acid (BNA)
gguaaguucuguccaagcc

SEQ ID NO: 2789 - RNA, 17 nt, Artificial Sequence
  Description of Artificial Sequence: Synthetic Antisense oligonucleotide
  misc_feature (1)..(2): bicyclic nucleic acid (BNA)
gguaaguucuguccaag

SEQ ID NO: 2790 - RNA, 16 nt, Artificial Sequence
  Description of Artificial Sequence: Synthetic Antisense oligonucleotide
  misc_feature (1)..(2): bicyclic nucleic acid (BNA)
gguaaguucuguccaa

SEQ ID NO: 2791 - RNA, 15 nt, Artificial Sequence
  Description of Artificial Sequence: Synthetic Antisense oligonucleotide
  misc_feature (1)..(2): bicyclic nucleic acid (BNA)
gguaaguucugucca

SEQ ID NO: 2792 - RNA, 14 nt, Artificial Sequence
  Description of Artificial Sequence: Synthetic Antisense oligonucleotide
  misc_feature (1)..(2): bicyclic nucleic acid (BNA)
gguaaguucugucc

SEQ ID NO: 2793 - RNA, 13 nt, Artificial Sequence
  Description of Artificial Sequence: Synthetic Antisense oligonucleotide
  misc_feature (1)..(2): bicyclic nucleic acid (BNA)
gguaaguucuguc

SEQ ID NO: 2794 - RNA, 12 nt, Artificial Sequence
  Description of Artificial Sequence: Synthetic Antisense oligonucleotide
  misc_feature (1)..(2): bicyclic nucleic acid (BNA)
gguaaguucugu

SEQ ID NO: 2795 - RNA, 11 nt, Artificial Sequence
  Description of Artificial Sequence: Synthetic Antisense oligonucleotide
  misc_feature (1)..(2): bicyclic nucleic acid (BNA)
gguaaguucug

SEQ ID NO: 2796 - RNA, 10 nt, Artificial Sequence
  Description of Artificial Sequence: Synthetic Antisense oligonucleotide
  misc_feature (1)..(2): bicyclic nucleic acid (BNA)
gguaaguucu

SEQ ID NO: 2797 - RNA, 9 nt, Artificial Sequence
  Description of Artificial Sequence: Synthetic Antisense oligonucleotide
  misc_feature (1)..(2): bicyclic nucleic acid (BNA)
gguaaguuc

SEQ ID NO: 2798 - RNA, 8 nt, Artificial Sequence
  Description of Artificial Sequence: Synthetic Antisense oligonucleotide
  misc_feature (1)..(2): bicyclic nucleic acid (BNA)
gguaaguu

SEQ ID NO: 2799 - RNA, 20 nt, Artificial Sequence
  Description of Artificial Sequence: Synthetic Antisense oligonucleotide
  misc_feature (1)..(2): bicyclic nucleic acid (BNA)
cgguaaguucuguccaagcc

SEQ ID NO: 2800 - RNA, 19 nt, Artificial Sequence
  Description of Artificial Sequence: Synthetic Antisense oligonucleotide
  misc_feature (1)..(2): bicyclic nucleic acid (BNA)
cgguaaguucuguccaagc

SEQ ID NO: 2801 - RNA, 18 nt, Artificial Sequence
  Description of Artificial Sequence: Synthetic Antisense oligonucleotide
  misc_feature (1)..(2): bicyclic nucleic acid (BNA)
cgguaaguucuguccaag

SEQ ID NO: 2802 - RNA, 17 nt, Artificial Sequence
  Description of Artificial Sequence: Synthetic Antisense oligonucleotide
  misc_feature (1)..(2): bicyclic nucleic acid (BNA)
cgguaaguucuguccaa

SEQ ID NO: 2803 - RNA, 16 nt, Artificial Sequence
  Description of Artificial Sequence: Synthetic Antisense oligonucleotide
  misc_feature (1)..(2): bicyclic nucleic acid (BNA)
cgguaaguucugucca

SEQ ID NO: 2804 - RNA, 15 nt, Artificial Sequence
  Description of Artificial Sequence: Synthetic Antisense oligonucleotide
  misc_feature (1)..(2): bicyclic nucleic acid (BNA)
cgguaaguucugucc

SEQ ID NO: 2805 - RNA, 14 nt, Artificial Sequence
  Description of Artificial Sequence: Synthetic Antisense oligonucleotide
  misc_feature (1)..(2): bicyclic nucleic acid (BNA)
cgguaaguucuguc

SEQ ID NO: 2806 - RNA, 13 nt, Artificial Sequence
  Description of Artificial Sequence: Synthetic Antisense oligonucleotide
  misc_feature (1)..(2): bicyclic nucleic acid (BNA)
cgguaaguucugu

SEQ ID NO: 2807 - RNA, 12 nt, Artificial Sequence
  Description of Artificial Sequence: Synthetic Antisense oligonucleotide
  misc_feature (1)..(2): bicyclic nucleic acid (BNA)
cgguaaguucug

SEQ ID NO: 2808 - RNA, 11 nt, Artificial Sequence
  Description of Artificial Sequence: Synthetic Antisense oligonucleotide
  misc_feature (1)..(2): bicyclic nucleic acid (BNA)
cgguaaguucu

SEQ ID NO: 2809 - RNA, 10 nt, Artificial Sequence
  Description of Artificial Sequence: Synthetic Antisense oligonucleotide
  misc_feature (1)..(2): bicyclic nucleic acid (BNA)
cgguaaguuc

SEQ ID NO: 2810 - RNA, 9 nt, Artificial Sequence
  Description of Artificial Sequence: Synthetic Antisense oligonucleotide
  misc_feature (1)..(2): bicyclic nucleic acid (BNA)
cgguaaguu

SEQ ID NO: 2811 - RNA, 8 nt, Artificial Sequence
  Description of Artificial Sequence: Synthetic Antisense oligonucleotide
  misc_feature (1)..(2): bicyclic nucleic acid (BNA)
cgguaagu

SEQ ID NO: 2812 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcgguaaguucuguccaagc

SEQ ID NO: 2813 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcgguaaguucuguccaag

SEQ ID NO: 2814 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcgguaaguucuguccaa

SEQ ID NO: 2815 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcgguaaguucugucca

SEQ ID NO: 2816 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcgguaaguucugucc

SEQ ID NO: 2817 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcgguaaguucuguc

SEQ ID NO: 2818 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcgguaaguucugu

SEQ ID NO: 2819 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcgguaaguucug

SEQ ID NO: 2820 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcgguaaguucu

SEQ ID NO: 2821 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcgguaaguuc

SEQ ID NO: 2822 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcgguaaguu

SEQ ID NO: 2823 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcgguaagu

SEQ ID NO: 2824 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtcgguaaguucuguccaag

SEQ ID NO: 2825 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtcgguaaguucuguccaa

SEQ ID NO: 2826 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtcgguaaguucugucca

SEQ ID NO: 2827 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtcgguaaguucugucc

SEQ ID NO: 2828 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtcgguaaguucuguc

SEQ ID NO: 2829 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtcgguaaguucugu

SEQ ID NO: 2830 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtcgguaaguucug

SEQ ID NO: 2831 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtcgguaaguucu

SEQ ID NO: 2832 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtcgguaaguuc

SEQ ID NO: 2833 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtcgguaaguu

SEQ ID NO: 2834 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
gtcgguaagu

SEQ ID NO: 2835 - RNA, 20 nt, Artificial Sequence
  Description of Artificial Sequence: Synthetic Antisense oligonucleotide
  misc_feature (1)..(2): bicyclic nucleic acid (BNA)
agucgguaaguucuguccaa

SEQ ID NO: 2836 - RNA, 19 nt, Artificial Sequence
  Description of Artificial Sequence: Synthetic Antisense oligonucleotide
  misc_feature (1)..(2): bicyclic nucleic acid (BNA)
agucgguaaguucugucca

SEQ ID NO: 2837 - RNA, 17 nt, Artificial Sequence
  Description of Artificial Sequence: Synthetic Antisense oligonucleotide
  misc_feature (1)..(2): bicyclic nucleic acid (BNA)
agucgguaaguucuguc

SEQ ID NO: 2838 - RNA, 16 nt, Artificial Sequence
  Description of Artificial Sequence: Synthetic Antisense oligonucleotide
  misc_feature (1)..(2): bicyclic nucleic acid (BNA)
agucgguaaguucugu

SEQ ID NO: 2839 - RNA, 15 nt, Artificial Sequence
  Description of Artificial Sequence: Synthetic Antisense oligonucleotide
  misc_feature (1)..(2): bicyclic nucleic acid (BNA)
agucgguaaguucug

SEQ ID NO: 2840 - RNA, 14 nt, Artificial Sequence
  Description of Artificial Sequence: Synthetic Antisense oligonucleotide
  misc_feature (1)..(2): bicyclic nucleic acid (BNA)
agucgguaaguucu

SEQ ID NO: 2841 - RNA, 13 nt, Artificial Sequence
  Description of Artificial Sequence: Synthetic Antisense oligonucleotide
  misc_feature (1)..(2): bicyclic nucleic acid (BNA)
agucgguaaguuc

SEQ ID NO: 2842 - RNA, 12 nt, Artificial Sequence
  Description of Artificial Sequence: Synthetic Antisense oligonucleotide
  misc_feature (1)..(2): bicyclic nucleic acid (BNA)
agucgguaaguu

SEQ ID NO: 2843 - RNA, 11 nt, Artificial Sequence
  Description of Artificial Sequence: Synthetic Antisense oligonucleotide
  misc_feature (1)..(2): bicyclic nucleic acid (BNA)
agucgguaagu

SEQ ID NO: 2844 - RNA, 20 nt, Artificial Sequence
  Description of Artificial Sequence: Synthetic Antisense oligonucleotide
  misc_feature (1)..(2): bicyclic nucleic acid (BNA)
cagucgguaaguucugucca

SEQ ID NO: 2845 - RNA, 19 nt, Artificial Sequence
  Description of Artificial Sequence: Synthetic Antisense oligonucleotide
  misc_feature (1)..(2): bicyclic nucleic acid (BNA)
cagucgguaaguucugucc

SEQ ID NO: 2846 - RNA, 18 nt, Artificial Sequence
  Description of Artificial Sequence: Synthetic Antisense oligonucleotide
  misc_feature (1)..(2): bicyclic nucleic acid (BNA)
cagucgguaaguucuguc

SEQ ID NO: 2847 - RNA, 17 nt, Artificial Sequence
  Description of Artificial Sequence: Synthetic Antisense oligonucleotide
  misc_feature (1)..(2): bicyclic nucleic acid (BNA)
cagucgguaaguucugu

SEQ ID NO: 2848 - RNA, 16 nt, Artificial Sequence
  Description of Artificial Sequence: Synthetic Antisense oligonucleotide
  misc_feature (1)..(2): bicyclic nucleic acid (BNA)
cagucgguaaguucug

SEQ ID NO: 2849 - RNA, 15 nt, Artificial Sequence
  Description of Artificial Sequence: Synthetic Antisense oligonucleotide
  misc_feature (1)..(2): bicyclic nucleic acid (BNA)
cagucgguaaguucu

SEQ ID NO: 2850 - RNA, 14 nt, Artificial Sequence
  Description of Artificial Sequence: Synthetic Antisense oligonucleotide
  misc_feature (1)..(2): bicyclic nucleic acid (BNA)
cagucgguaaguuc

SEQ ID NO: 2851 - RNA, 13 nt, Artificial Sequence
  Description of Artificial Sequence: Synthetic Antisense oligonucleotide
  misc_feature (1)..(2): bicyclic nucleic acid (BNA)
cagucgguaaguu

SEQ ID NO: 2852 - RNA, 12 nt, Artificial Sequence
  Description of Artificial Sequence: Synthetic Antisense oligonucleotide
  misc_feature (1)..(2): bicyclic nucleic acid (BNA)
cagucgguaagu

SEQ ID NO: 2853 - RNA, 20 nt, Artificial Sequence
  Description of Artificial Sequence: Synthetic Antisense oligonucleotide
  misc_feature (1)..(2): bicyclic nucleic acid (BNA)
ccagucgguaaguucugucc

SEQ ID NO: 2854 - RNA, 19 nt, Artificial Sequence
  Description of Artificial Sequence: Synthetic Antisense oligonucleotide
  misc_feature (1)..(2): bicyclic nucleic acid (BNA)
ccagucgguaaguucuguc

SEQ ID NO: 2855 - RNA, 18 nt, Artificial Sequence
  Description of Artificial Sequence: Synthetic Antisense oligonucleotide
  misc_feature (1)..(2): bicyclic nucleic acid (BNA)
ccagucgguaaguucugu

SEQ ID NO: 2856 - RNA, 17 nt, Artificial Sequence
  Description of Artificial Sequence: Synthetic Antisense oligonucleotide
  misc_feature (1)..(2): bicyclic nucleic acid (BNA)
ccagucgguaaguucug

SEQ ID NO: 2857 - RNA, 16 nt, Artificial Sequence
  Description of Artificial Sequence: Synthetic Antisense oligonucleotide
  misc_feature (1)..(2): bicyclic nucleic acid (BNA)
ccagucgguaaguucu

SEQ ID NO: 2858 - RNA, 15 nt, Artificial Sequence
  Description of Artificial Sequence: Synthetic Antisense oligonucleotide
  misc_feature (1)..(2): bicyclic nucleic acid (BNA)
ccagucgguaaguuc

SEQ ID NO: 2859 - RNA, 14 nt, Artificial Sequence
  Description of Artificial Sequence: Synthetic Antisense oligonucleotide
  misc_feature (1)..(2): bicyclic nucleic acid (BNA)
ccagucgguaaguu

SEQ ID NO: 2860 - RNA, 13 nt, Artificial Sequence
  Description of Artificial Sequence: Synthetic Antisense oligonucleotide
  misc_feature (1)..(2): bicyclic nucleic acid (BNA)
ccagucgguaagu

SEQ ID NO: 2861 - RNA, 20 nt, Artificial Sequence
  Description of Artificial Sequence: Synthetic Antisense oligonucleotide
  misc_feature (1)..(2): bicyclic nucleic acid (BNA)
gccagucgguaaguucuguc

SEQ ID NO: 2862 - RNA, 19 nt, Artificial Sequence
  Description of Artificial Sequence: Synthetic Antisense oligonucleotide
  misc_feature (1)..(2): bicyclic nucleic acid (BNA)
gccagucgguaaguucugu

SEQ ID NO: 2863 - RNA, 18 nt, Artificial Sequence
  Description of Artificial Sequence: Synthetic Antisense oligonucleotide
  misc_feature (1)..(2): bicyclic nucleic acid (BNA)
gccagucgguaaguucug

SEQ ID NO: 2864 - RNA, 17 nt, Artificial Sequence
  Description of Artificial Sequence: Synthetic Antisense oligonucleotide
  misc_feature (1)..(2): bicyclic nucleic acid (BNA)
gccagucgguaaguucu

SEQ ID NO: 2865 - RNA, 16 nt, Artificial Sequence
  Description of Artificial Sequence: Synthetic Antisense oligonucleotide
  misc_feature (1)..(2): bicyclic nucleic acid (BNA)
gccagucgguaaguuc

SEQ ID NO: 2866 - RNA, 15 nt, Artificial Sequence
  Description of Artificial Sequence: Synthetic Antisense oligonucleotide
  misc_feature (1)..(2): bicyclic nucleic acid (BNA)
gccagucgguaaguu

SEQ ID NO: 2867 - RNA, 14 nt, Artificial Sequence
  Description of Artificial Sequence: Synthetic Antisense oligonucleotide
  misc_feature (1)..(2): bicyclic nucleic acid (BNA)
gccagucgguaagu

SEQ ID NO: 2868 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcaaggaagauggcauuucu

SEQ ID NO: 2869 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcaaggaagauggcauuucuag

SEQ ID NO: 2870 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcaaggaagauggcau

SEQ ID NO: 2871 - RNA, 15 nt, Artificial Sequence
  Description of Artificial Sequence: Synthetic Antisense oligonucleotide
  misc_feature (1)..(2): bicyclic nucleic acid (BNA)
gaagauggcauuucu

SEQ ID NO: 2872 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcaaggaagauggcauuucua

SEQ ID NO: 2873 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcaaggaagauggcauuuc

SEQ ID NO: 2874 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcaaggaagauggcauuu

SEQ ID NO: 2875 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcaaggaagauggcauu

SEQ ID NO: 2876 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcaaggaagauggca

SEQ ID NO: 2877 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcaaggaagauggc

SEQ ID NO: 2878 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcaaggaagaugg

SEQ ID NO: 2879 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcaaggaagaug

SEQ ID NO: 2880 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcaaggaagau

SEQ ID NO: 2881 - DNA, 10 bp, Artificial Sequence
  Description of Artificial Sequence: Synthetic Antisense oligonucleotide
  misc_feature (1)..(2): bicyclic nucleic acid (BNA)
tcaaggaaga

SEQ ID NO: 2882 - DNA, 9 bp, Artificial Sequence
  Description of Artificial Sequence: Synthetic Antisense oligonucleotide
  misc_feature (1)..(2): bicyclic nucleic acid (BNA)
tcaaggaag

SEQ ID NO: 2883 - RNA, 21 nt, Artificial Sequence
  Description of Artificial Sequence: Synthetic Antisense oligonucleotide
  misc_feature (1)..(2): bicyclic nucleic acid (BNA)
caaggaagauggcauuucuag

SEQ ID NO: 2884 - RNA, 20 nt, Artificial Sequence
  Description of Artificial Sequence: Synthetic Antisense oligonucleotide
  misc_feature (1)..(2): bicyclic nucleic acid (BNA)
caaggaagauggcauuucua

SEQ ID NO: 2885 - RNA, 19 nt, Artificial Sequence
  Description of Artificial Sequence: Synthetic Antisense oligonucleotide
  misc_feature (1)..(2): bicyclic nucleic acid (BNA)
caaggaagauggcauuucu

SEQ ID NO: 2886 - RNA, 18 nt, Artificial Sequence
  Description of Artificial Sequence: Synthetic Antisense oligonucleotide
  misc_feature (1)..(2): bicyclic nucleic acid (BNA)
caaggaagauggcauuuc

SEQ ID NO: 2887 - RNA, 17 nt, Artificial Sequence
  Description of Artificial Sequence: Synthetic Antisense oligonucleotide
  misc_feature (1)..(2): bicyclic nucleic acid (BNA)
caaggaagauggcauuu

SEQ ID NO: 2888 - RNA, 16 nt, Artificial Sequence
  Description of Artificial Sequence: Synthetic Antisense oligonucleotide
  misc_feature (1)..(2): bicyclic nucleic acid (BNA)
caaggaagauggcauu

SEQ ID NO: 2889 - RNA, 15 nt, Artificial Sequence
  Description of Artificial Sequence: Synthetic Antisense oligonucleotide
  misc_feature (1)..(2): bicyclic nucleic acid (BNA)
caaggaagauggcau

SEQ ID NO: 2890 - RNA, 14 nt, Artificial Sequence
  Description of Artificial Sequence: Synthetic Antisense oligonucleotide
  misc_feature (1)..(2): bicyclic nucleic acid (BNA)
caaggaagauggca

SEQ ID NO: 2891 - RNA, 13 nt, Artificial Sequence
  Description of Artificial Sequence: Synthetic Antisense oligonucleotide
  misc_feature (1)..(2): bicyclic nucleic acid (BNA)
caaggaagauggc

SEQ ID NO: 2892 - RNA, 12 nt, Artificial Sequence
  Description of Artificial Sequence: Synthetic Antisense oligonucleotide
  misc_feature (1)..(2): bicyclic nucleic acid (BNA)
caaggaagaugg

SEQ ID NO: 2893 - RNA, 11 nt, Artificial Sequence
  Description of Artificial Sequence: Synthetic Antisense oligonucleotide
  misc_feature (1)..(2): bicyclic nucleic acid (BNA)
caaggaagaug

SEQ ID NO: 2894 - RNA, 10 nt, Artificial Sequence
  Description of Artificial Sequence: Synthetic Antisense oligonucleotide
  misc_feature (1)..(2): bicyclic nucleic acid (BNA)
caaggaagau

SEQ ID NO: 2895 - RNA, 9 nt, Artificial Sequence
  Description of Artificial Sequence: Synthetic Antisense oligonucleotide
  misc_feature (1)..(2): bicyclic nucleic acid (BNA)
caaggaaga

SEQ ID NO: 2896 - RNA, 8 nt, Artificial Sequence
  Description of Artificial Sequence: Synthetic Antisense oligonucleotide
  misc_feature (1)..(2): bicyclic nucleic acid (BNA)
caaggaag

SEQ ID NO: 2897 - RNA, 20 nt, Artificial Sequence
  Description of Artificial Sequence: Synthetic Antisense oligonucleotide
  misc_feature (1)..(2): bicyclic nucleic acid (BNA)
aaggaagauggcauuucuag

SEQ ID NO: 2898 - RNA, 19 nt, Artificial Sequence
  Description of Artificial Sequence: Synthetic Antisense oligonucleotide
  misc_feature (1)..(2): bicyclic nucleic acid (BNA)
aaggaagauggcauuucua

SEQ ID NO: 2899 - RNA, 18 nt, Artificial Sequence
  Description of Artificial Sequence: Synthetic Antisense oligonucleotide
  misc_feature (1)..(2): bicyclic nucleic acid (BNA)
aaggaagauggcauuucu

SEQ ID NO: 2900 - RNA, 17 nt, Artificial Sequence
  Description of Artificial Sequence: Synthetic Antisense oligonucleotide
  misc_feature (1)..(2): bicyclic nucleic acid (BNA)
aaggaagauggcauuuc

SEQ ID NO: 2901 - RNA, 16 nt, Artificial Sequence
  Description of Artificial Sequence: Synthetic Antisense oligonucleotide
  misc_feature (1)..(2): bicyclic nucleic acid (BNA)
aaggaagauggcauuu

SEQ ID NO: 2902 - RNA, 15 nt, Artificial Sequence
  Description of Artificial Sequence: Synthetic Antisense oligonucleotide
  misc_feature (1)..(2): bicyclic nucleic acid (BNA)
aaggaagauggcauu

SEQ ID NO: 2903 - RNA, 14 nt, Artificial Sequence
  Description of Artificial Sequence: Synthetic Antisense oligonucleotide
  misc_feature (1)..(2): bicyclic nucleic acid (BNA)
aaggaagauggcau

SEQ ID NO: 2904 - RNA, 13 nt, Artificial Sequence
  Description of Artificial Sequence: Synthetic Antisense oligonucleotide
  misc_feature (1)..(2): bicyclic nucleic acid (BNA)
aaggaagauggca

SEQ ID NO: 2905 - RNA, 12 nt, Artificial Sequence
  Description of Artificial Sequence: Synthetic Antisense oligonucleotide
  misc_feature (1)..(2): bicyclic nucleic acid (BNA)
aaggaagauggc

SEQ ID NO: 2906 - RNA, 11 nt, Artificial Sequence
  Description of Artificial Sequence: Synthetic Antisense oligonucleotide
  misc_feature (1)..(2): bicyclic nucleic acid (BNA)
aaggaagaugg

SEQ ID NO: 2907 - RNA, 10 nt, Artificial Sequence
  Description of Artificial Sequence: Synthetic Antisense oligonucleotide
  misc_feature (1)..(2): bicyclic nucleic acid (BNA)
aaggaagaug

SEQ ID NO: 2908 - RNA, 9 nt, Artificial Sequence
  Description of Artificial Sequence: Synthetic Antisense oligonucleotide
  misc_feature (1)..(2): bicyclic nucleic acid (BNA)
aaggaagau

SEQ ID NO: 2909 - RNA, 8 nt, Artificial Sequence
  Description of Artificial Sequence: Synthetic Antisense oligonucleotide
  misc_feature (1)..(2): bicyclic nucleic acid (BNA)
aaggaaga

SEQ ID NO: 2910 - RNA, 19 nt, Artificial Sequence
  Description of Artificial Sequence: Synthetic Antisense oligonucleotide
  misc_feature (1)..(2): bicyclic nucleic acid (BNA)
aggaagauggcauuucuag

SEQ ID NO: 2911 - RNA, 18 nt, Artificial Sequence
  Description of Artificial Sequence: Synthetic Antisense oligonucleotide
  misc_feature (1)..(2): bicyclic nucleic acid (BNA)
aggaagauggcauuucua

SEQ ID NO: 2912 - RNA, 17 nt, Artificial Sequence
  Description of Artificial Sequence: Synthetic Antisense oligonucleotide
  misc_feature (1)..(2): bicyclic nucleic acid (BNA)
aggaagauggcauuucu

SEQ ID NO: 2913 - RNA, 16 nt, Artificial Sequence
  Description of Artificial Sequence: Synthetic Antisense oligonucleotide
  misc_feature (1)..(2): bicyclic nucleic acid (BNA)
aggaagauggcauuuc

SEQ ID NO: 2914 - RNA, 15 nt, Artificial Sequence
  Description of Artificial Sequence: Synthetic Antisense oligonucleotide
  misc_feature (1)..(2): bicyclic nucleic acid (BNA)
aggaagauggcauuu

SEQ ID NO: 2915 - RNA, 14 nt, Artificial Sequence
  Description of Artificial Sequence: Synthetic Antisense oligonucleotide
  misc_feature (1)..(2): bicyclic nucleic acid (BNA)
aggaagauggcauu

SEQ ID NO: 2916 - RNA, 13 nt, Artificial Sequence
  Description of Artificial Sequence: Synthetic Antisense oligonucleotide
  misc_feature (1)..(2): bicyclic nucleic acid (BNA)
aggaagauggcau

SEQ ID NO: 2917 - RNA, 12 nt, Artificial Sequence
  Description of Artificial Sequence: Synthetic Antisense oligonucleotide
  misc_feature (1)..(2): bicyclic nucleic acid (BNA)
aggaagauggca

SEQ ID NO: 2918 - RNA, 10 nt, Artificial Sequence
  Description of Artificial Sequence: Synthetic Antisense oligonucleotide
  misc_feature (1)..(2): bicyclic nucleic acid (BNA)
aggaagaugg

SEQ ID NO: 2919 - RNA, 9 nt, Artificial Sequence
  Description of Artificial Sequence: Synthetic Antisense oligonucleotide
  misc_feature (1)..(2): bicyclic nucleic acid (BNA)
aggaagaug

SEQ ID NO: 2920 - RNA, 8 nt, Artificial Sequence
  Description of Artificial Sequence: Synthetic Antisense oligonucleotide
  misc_feature (1)..(2): bicyclic nucleic acid (BNA)
aggaagau

SEQ ID NO: 2921 - RNA, 18 nt, Artificial Sequence
  Description of Artificial Sequence: Synthetic Antisense oligonucleotide
  misc_feature (1)..(2): bicyclic nucleic acid (BNA)
ggaagauggcauuucuag

SEQ ID NO: 2922 - RNA, 17 nt, Artificial Sequence
  Description of Artificial Sequence: Synthetic Antisense oligonucleotide
  misc_feature (1)..(2): bicyclic nucleic acid (BNA)
ggaagauggcauuucua

SEQ ID NO: 2923 - RNA, 16 nt, Artificial Sequence
  Description of Artificial Sequence: Synthetic Antisense oligonucleotide
  misc_feature (1)..(2): bicyclic nucleic acid (BNA)
ggaagauggcauuucu

SEQ ID NO: 2924 - RNA, 15 nt, Artificial Sequence
  Description of Artificial Sequence: Synthetic Antisense oligonucleotide
  misc_feature (1)..(2): bicyclic nucleic acid (BNA)
ggaagauggcauuuc

SEQ ID NO: 2925 - RNA, 14 nt, Artificial Sequence
  Description of Artificial Sequence: Synthetic Antisense oligonucleotide
  misc_feature (1)..(2): bicyclic nucleic acid (BNA)
ggaagauggcauuu

SEQ ID NO: 2926 - RNA, 13 nt, Artificial Sequence
  Description of Artificial Sequence: Synthetic Antisense oligonucleotide
  misc_feature (1)..(2): bicyclic nucleic acid (BNA)
ggaagauggcauu

SEQ ID NO: 2927 - RNA, 12 nt, Artificial Sequence
  Description of Artificial Sequence: Synthetic Antisense oligonucleotide
  misc_feature (1)..(2): bicyclic nucleic acid (BNA)
ggaagauggcau

SEQ ID NO: 2928 - RNA, 11 nt, Artificial Sequence
  Description of Artificial Sequence: Synthetic Antisense oligonucleotide
  misc_feature (1)..(2): bicyclic nucleic acid (BNA)
ggaagauggca

SEQ ID NO: 2929 - RNA, 10 nt, Artificial Sequence
  Description of Artificial Sequence: Synthetic Antisense oligonucleotide
  misc_feature (1)..(2): bicyclic nucleic acid (BNA)
ggaagauggc

SEQ ID NO: 2930 - RNA, 8 nt, Artificial Sequence
  Description of Artificial Sequence: Synthetic Antisense oligonucleotide
  misc_feature (1)..(2): bicyclic nucleic acid (BNA)
ggaagaug

SEQ ID NO: 2931 - RNA, 17 nt, Artificial Sequence
  Description of Artificial Sequence: Synthetic Antisense oligonucleotide
  misc_feature (1)..(2): bicyclic nucleic acid (BNA)
gaagauggcauuucuag

SEQ ID NO: 2932 - RNA, 16 nt, Artificial Sequence
  Description of Artificial Sequence: Synthetic Antisense oligonucleotide
  misc_feature (1)..(2): bicyclic nucleic acid (BNA)
gaagauggcauuucua

SEQ ID NO: 2933 - RNA, 14 nt, Artificial Sequence
  Description of Artificial Sequence: Synthetic Antisense oligonucleotide
  misc_feature (1)..(2): bicyclic nucleic acid (BNA)
gaagauggcauuuc

SEQ ID NO: 2934 - RNA, 13 nt, Artificial Sequence
  Description of Artificial Sequence: Synthetic Antisense oligonucleotide
  misc_feature (1)..(2): bicyclic nucleic acid (BNA)
gaagauggcauuu

SEQ ID NO: 2935 - RNA, 12 nt, Artificial Sequence
  Description of Artificial Sequence: Synthetic Antisense oligonucleotide
  misc_feature (1)..(2): bicyclic nucleic acid (BNA)
gaagauggcauu

SEQ ID NO: 2936 - RNA, 11 nt, Artificial Sequence
  Description of Artificial Sequence: Synthetic Antisense oligonucleotide
  misc_feature (1)..(2): bicyclic nucleic acid (BNA)
gaagauggcau

SEQ ID NO: 2937 - RNA, 10 nt, Artificial Sequence
  Description of Artificial Sequence: Synthetic Antisense oligonucleotide
  misc_feature (1)..(2): bicyclic nucleic acid (BNA)
gaagauggca

SEQ ID NO: 2938 - RNA, 9 nt, Artificial Sequence
  Description of Artificial Sequence: Synthetic Antisense oligonucleotide
  misc_feature (1)..(2): bicyclic nucleic acid (BNA)
gaagauggc

SEQ ID NO: 2939 - RNA, 8 nt, Artificial Sequence
  Description of Artificial Sequence: Synthetic Antisense oligonucleotide
  misc_feature (1)..(2): bicyclic nucleic acid (BNA)
gaagaugg

SEQ ID NO: 2940 - RNA, 16 nt, Artificial Sequence
  Description of Artificial Sequence: Synthetic Antisense oligonucleotide
  misc_feature (1)..(2): bicyclic nucleic acid (BNA)
aagauggcauuucuag

SEQ ID NO: 2941 - RNA, 15 nt, Artificial Sequence
  Description of Artificial Sequence: Synthetic Antisense oligonucleotide
  misc_feature (1)..(2): bicyclic nucleic acid (BNA)
aagauggcauuucua

SEQ ID NO: 2942 - RNA, 14 nt, Artificial Sequence
  Description of Artificial Sequence: Synthetic Antisense oligonucleotide
  misc_feature (1)..(2): bicyclic nucleic acid (BNA)
aagauggcauuucu

SEQ ID NO: 2943 - RNA, 13 nt, Artificial Sequence
  Description of Artificial Sequence: Synthetic Antisense oligonucleotide
  misc_feature (1)..(2): bicyclic nucleic acid (BNA)
aagauggcauuuc

SEQ ID NO: 2944 - RNA, 12 nt, Artificial Sequence
  Description of Artificial Sequence: Synthetic Antisense oligonucleotide
  misc_feature (1)..(2): bicyclic nucleic acid (BNA)
aagauggcauuu

SEQ ID NO: 2945 - RNA, 11 nt, Artificial Sequence
  Description of Artificial Sequence: Synthetic Antisense oligonucleotide
  misc_feature (1)..(2): bicyclic nucleic acid (BNA)
aagauggcauu

SEQ ID NO: 2946 - RNA, 10 nt, Artificial Sequence
  Description of Artificial Sequence: Synthetic Antisense oligonucleotide
  misc_feature (1)..(2): bicyclic nucleic acid (BNA)
aagauggcau

SEQ ID NO: 2947 - RNA, 9 nt, Artificial Sequence
  Description of Artificial Sequence: Synthetic Antisense oligonucleotide
  misc_feature (1)..(2): bicyclic nucleic acid (BNA)
aagauggca

SEQ ID NO: 2948 - RNA, 8 nt, Artificial Sequence
  Description of Artificial Sequence: Synthetic Antisense oligonucleotide
  misc_feature (1)..(2): bicyclic nucleic acid (BNA)
aagauggc

SEQ ID NO: 2949 - RNA, 15 nt, Artificial Sequence
  Description of Artificial Sequence: Synthetic Antisense oligonucleotide
  misc_feature (1)..(2): bicyclic nucleic acid (BNA)
agauggcauuucuag

SEQ ID NO: 2950 - RNA, 14 nt, Artificial Sequence
  Description of Artificial Sequence: Synthetic Antisense oligonucleotide
  misc_feature (1)..(2): bicyclic nucleic acid (BNA)
agauggcauuucua

SEQ ID NO: 2951 - RNA, 13 nt, Artificial Sequence
  Description of Artificial Sequence: Synthetic Antisense oligonucleotide
  misc_feature (1)..(2): bicyclic nucleic acid (BNA)
agauggcauuucu

SEQ ID NO: 2952 - RNA, 12 nt, Artificial Sequence
  Description of Artificial Sequence: Synthetic Antisense oligonucleotide
  misc_feature (1)..(2): bicyclic nucleic acid (BNA)
agauggcauuuc

SEQ ID NO: 2953 - RNA, 11 nt, Artificial Sequence
  Description of Artificial Sequence: Synthetic Antisense oligonucleotide
  misc_feature (1)..(2): bicyclic nucleic acid (BNA)
agauggcauuu

SEQ ID NO: 2954 - RNA, 10 nt, Artificial Sequence
  Description of Artificial Sequence: Synthetic Antisense oligonucleotide
  misc_feature (1)..(2): bicyclic nucleic acid (BNA)
agauggcauu

SEQ ID NO: 2955 - RNA, 9 nt, Artificial Sequence
  Description of Artificial Sequence: Synthetic Antisense oligonucleotide
  misc_feature (1)..(2): bicyclic nucleic acid (BNA)
agauggcau

SEQ ID NO: 2956 - RNA, 8 nt, Artificial Sequence
  Description of Artificial Sequence: Synthetic Antisense oligonucleotide
  misc_feature (1)..(2): bicyclic nucleic acid (BNA)
agauggca

SEQ ID NO: 2957 - DNA, 30 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctccaacaucaaggaagauggcauuucuag

SEQ ID NO: 2958 - DNA, 29 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctccaacaucaaggaagauggcauuucua

SEQ ID NO: 2959 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctccaacaucaaggaagauggcauuucu

SEQ ID NO: 2960 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctccaacaucaaggaagauggcauuuc

SEQ ID NO: 2961 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctccaacaucaaggaagauggcauuu

SEQ ID NO: 2962 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctccaacaucaaggaagauggcauu

SEQ ID NO: 2963 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctccaacaucaaggaagauggcau

SEQ ID NO: 2964 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctccaacaucaaggaagauggca

SEQ ID NO: 2965 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctccaacaucaaggaagauggc

SEQ ID NO: 2966 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctccaacaucaaggaagaugg

SEQ ID NO: 2967 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctccaacaucaaggaagaug

SEQ ID NO: 2968 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctccaacaucaaggaagau

SEQ ID NO: 2969 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctccaacaucaaggaaga

SEQ ID NO: 2970 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
ctccaacaucaaggaag

SEQ ID NO: 2971 - DNA, 29 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tccaacaucaaggaagauggcauuucuag

SEQ ID NO: 2972 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tccaacaucaaggaagauggcauuucua

SEQ ID NO: 2973 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tccaacaucaaggaagauggcauuucu

SEQ ID NO: 2974 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tccaacaucaaggaagauggcauuuc

SEQ ID NO: 2975 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tccaacaucaaggaagauggcauuu

SEQ ID NO: 2976 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tccaacaucaaggaagauggcauu

SEQ ID NO: 2977 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tccaacaucaaggaagauggcau

SEQ ID NO: 2978 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tccaacaucaaggaagauggca

SEQ ID NO: 2979 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tccaacaucaaggaagauggc

SEQ ID NO: 2980 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tccaacaucaaggaagaugg

SEQ ID NO: 2981 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tccaacaucaaggaagaug

SEQ ID NO: 2982 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tccaacaucaaggaagau

SEQ ID NO: 2983 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tccaacaucaaggaaga

SEQ ID NO: 2984 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tccaacaucaaggaag

SEQ ID NO: 2985 - RNA, 28 nt, Artificial Sequence
  Description of Artificial Sequence: Synthetic Antisense oligonucleotide
  misc_feature (1)..(2): bicyclic nucleic acid (BNA)
ccaacaucaaggaagauggcauuucuag

SEQ ID NO: 2986 - RNA, 27 nt, Artificial Sequence
  Description of Artificial Sequence: Synthetic Antisense oligonucleotide
  misc_feature (1)..(2): bicyclic nucleic acid (BNA)
ccaacaucaaggaagauggcauuucua

SEQ ID NO: 2987 - RNA, 26 nt, Artificial Sequence
  Description of Artificial Sequence: Synthetic Antisense oligonucleotide
  misc_feature (1)..(2): bicyclic nucleic acid (BNA)
ccaacaucaaggaagauggcauuucu

SEQ ID NO: 2988 - RNA, 25 nt, Artificial Sequence
  Description of Artificial Sequence: Synthetic Antisense oligonucleotide
  misc_feature (1)..(2): bicyclic nucleic acid (BNA)
ccaacaucaaggaagauggcauuuc

SEQ ID NO: 2989 - RNA, 24 nt, Artificial Sequence
  Description of Artificial Sequence: Synthetic Antisense oligonucleotide
  misc_feature (1)..(2): bicyclic nucleic acid (BNA)
ccaacaucaaggaagauggcauuu

SEQ ID NO: 2990 - RNA, 23 nt, Artificial Sequence
  Description of Artificial Sequence: Synthetic Antisense oligonucleotide
  misc_feature (1)..(2): bicyclic nucleic acid (BNA)
ccaacaucaaggaagauggcauu

SEQ ID NO: 2991 - RNA, 22 nt, Artificial Sequence
  Description of Artificial Sequence: Synthetic Antisense oligonucleotide
  misc_feature (1)..(2): bicyclic nucleic acid (BNA)
ccaacaucaaggaagauggcau

SEQ ID NO: 2992 - RNA, 21 nt, Artificial Sequence
  Description of Artificial Sequence: Synthetic Antisense oligonucleotide
  misc_feature (1)..(2): bicyclic nucleic acid (BNA)
ccaacaucaaggaagauggca

SEQ ID NO: 2993 - RNA, 20 nt, Artificial Sequence
  Description of Artificial Sequence: Synthetic Antisense oligonucleotide
  misc_feature (1)..(2): bicyclic nucleic acid (BNA)
ccaacaucaaggaagauggc

SEQ ID NO: 2994 - RNA, 19 nt, Artificial Sequence
  Description of Artificial Sequence: Synthetic Antisense oligonucleotide
  misc_feature (1)..(2): bicyclic nucleic acid (BNA)
ccaacaucaaggaagaugg

SEQ ID NO: 2995 - RNA, 18 nt, Artificial Sequence
  Description of Artificial Sequence: Synthetic Antisense oligonucleotide
  misc_feature (1)..(2): bicyclic nucleic acid (BNA)
ccaacaucaaggaagaug

SEQ ID NO: 2996 - RNA, 17 nt, Artificial Sequence
  Description of Artificial Sequence: Synthetic Antisense oligonucleotide
  misc_feature (1)..(2): bicyclic nucleic acid (BNA)
ccaacaucaaggaagau

SEQ ID NO: 2997 - RNA, 16 nt, Artificial Sequence
  Description of Artificial Sequence: Synthetic Antisense oligonucleotide
  misc_feature (1)..(2): bicyclic nucleic acid (BNA)
ccaacaucaaggaaga

SEQ ID NO: 2998 - RNA, 15 nt, Artificial Sequence
  Description of Artificial Sequence: Synthetic Antisense oligonucleotide
  misc_feature (1)..(2): bicyclic nucleic acid (BNA)
ccaacaucaaggaag

SEQ ID NO: 2999 - RNA, 27 nt, Artificial Sequence
  Description of Artificial Sequence: Synthetic Antisense oligonucleotide
  misc_feature (1)..(2): bicyclic nucleic acid (BNA)
caacaucaaggaagauggcauuucuag

SEQ ID NO: 3000 - RNA, 26 nt, Artificial Sequence
  Description of Artificial Sequence: Synthetic Antisense oligonucleotide
  misc_feature (1)..(2): bicyclic nucleic acid (BNA)
caacaucaaggaagauggcauuucua

SEQ ID NO: 3001 - RNA, 25 nt, Artificial Sequence
  Description of Artificial Sequence: Synthetic Antisense oligonucleotide
  misc_feature (1)..(2): bicyclic nucleic acid (BNA)
caacaucaaggaagauggcauuucu

SEQ ID NO: 3002 - RNA, 24 nt, Artificial Sequence
  Description of Artificial Sequence: Synthetic Antisense oligonucleotide
  misc_feature (1)..(2): bicyclic nucleic acid (BNA)
caacaucaaggaagauggcauuuc

SEQ ID NO: 3003 - RNA, 23 nt, Artificial Sequence
  Description of Artificial Sequence: Synthetic Antisense oligonucleotide
  misc_feature (1)..(2): bicyclic nucleic acid (BNA)
caacaucaaggaagauggcauuu

SEQ ID NO: 3004 - RNA, 22 nt, Artificial Sequence
  Description of Artificial Sequence: Synthetic Antisense oligonucleotide
  misc_feature (1)..(2): bicyclic nucleic acid (BNA)
caacaucaaggaagauggcauu

SEQ ID NO: 3005 - RNA, 21 nt, Artificial Sequence
  Description of Artificial Sequence: Synthetic Antisense oligonucleotide
  misc_feature (1)..(2): bicyclic nucleic acid (BNA)
caacaucaaggaagauggcau

SEQ ID NO: 3006 - RNA, 20 nt, Artificial Sequence
  Description of Artificial Sequence: Synthetic Antisense oligonucleotide
  misc_feature (1)..(2): bicyclic nucleic acid (BNA)
caacaucaaggaagauggca

SEQ ID NO: 3007 - RNA, 19 nt, Artificial Sequence
  Description of Artificial Sequence: Synthetic Antisense oligonucleotide
  misc_feature (1)..(2): bicyclic nucleic acid (BNA)
caacaucaaggaagauggc

SEQ ID NO: 3008 - RNA, 18 nt, Artificial Sequence
  Description of Artificial Sequence: Synthetic Antisense oligonucleotide
  misc_feature (1)..(2): bicyclic nucleic acid (BNA)
caacaucaaggaagaugg

SEQ ID NO: 3009 - RNA, 17 nt, Artificial Sequence
  Description of Artificial Sequence: Synthetic Antisense oligonucleotide
  misc_feature (1)..(2): bicyclic nucleic acid (BNA)
caacaucaaggaagaug

SEQ ID NO: 3010 - RNA, 16 nt, Artificial Sequence
  Description of Artificial Sequence: Synthetic Antisense oligonucleotide
  misc_feature (1)..(2): bicyclic nucleic acid (BNA)
caacaucaaggaagau

SEQ ID NO: 3011 - RNA, 15 nt, Artificial Sequence
  Description of Artificial Sequence: Synthetic Antisense oligonucleotide
  misc_feature (1)..(2): bicyclic nucleic acid (BNA)
caacaucaaggaaga

SEQ ID NO: 3012 - RNA, 14 nt, Artificial Sequence
  Description of Artificial Sequence: Synthetic Antisense oligonucleotide
  misc_feature (1)..(2): bicyclic nucleic acid (BNA)
caacaucaaggaag

SEQ ID NO: 3013 - RNA, 26 nt, Artificial Sequence
  Description of Artificial Sequence: Synthetic Antisense oligonucleotide
  misc_feature (1)..(2): bicyclic nucleic acid (BNA)
aacaucaaggaagauggcauuucuag

SEQ ID NO: 3014 - RNA, 25 nt, Artificial Sequence
  Description of Artificial Sequence: Synthetic Antisense oligonucleotide
  misc_feature (1)..(2): bicyclic nucleic acid (BNA)
aacaucaaggaagauggcauuucua

SEQ ID NO: 3015 - RNA, 24 nt, Artificial Sequence
  Description of Artificial Sequence: Synthetic Antisense oligonucleotide
  misc_feature (1)..(2): bicyclic nucleic acid (BNA)
aacaucaaggaagauggcauuucu

SEQ ID NO: 3016 - RNA, 23 nt, Artificial Sequence
  Description of Artificial Sequence: Synthetic Antisense oligonucleotide
  misc_feature (1)..(2): bicyclic nucleic acid (BNA)
aacaucaaggaagauggcauuuc

SEQ ID NO: 3017 - RNA, 22 nt, Artificial Sequence
  Description of Artificial Sequence: Synthetic Antisense oligonucleotide
  misc_feature (1)..(2): bicyclic nucleic acid (BNA)
aacaucaaggaagauggcauuu

SEQ ID NO: 3018 - RNA, 21 nt, Artificial Sequence
  Description of Artificial Sequence: Synthetic Antisense oligonucleotide
  misc_feature (1)..(2): bicyclic nucleic acid (BNA)
aacaucaaggaagauggcauu

SEQ ID NO: 3019 - RNA, 20 nt, Artificial Sequence
  Description of Artificial Sequence: Synthetic Antisense oligonucleotide
  misc_feature (1)..(2): bicyclic nucleic acid (BNA)
aacaucaaggaagauggcau

SEQ ID NO: 3020 - RNA, 19 nt, Artificial Sequence
  Description of Artificial Sequence: Synthetic Antisense oligonucleotide
  misc_feature (1)..(2): bicyclic nucleic acid (BNA)
aacaucaaggaagauggca

SEQ ID NO: 3021 - RNA, 18 nt, Artificial Sequence
  Description of Artificial Sequence: Synthetic Antisense oligonucleotide
  misc_feature (1)..(2): bicyclic nucleic acid (BNA)
aacaucaaggaagauggc

SEQ ID NO: 3022 - RNA, 17 nt, Artificial Sequence
  Description of Artificial Sequence: Synthetic Antisense oligonucleotide
  misc_feature (1)..(2): bicyclic nucleic acid (BNA)
aacaucaaggaagaugg

SEQ ID NO: 3023 - RNA, 16 nt, Artificial Sequence
  Description of Artificial Sequence: Synthetic Antisense oligonucleotide
  misc_feature (1)..(2): bicyclic nucleic acid (BNA)
aacaucaaggaagaug

SEQ ID NO: 3024 - RNA, 15 nt, Artificial Sequence
  Description of Artificial Sequence: Synthetic Antisense oligonucleotide
  misc_feature (1)..(2): bicyclic nucleic acid (BNA)
aacaucaaggaagau

SEQ ID NO: 3025 - RNA, 14 nt, Artificial Sequence
  Description of Artificial Sequence: Synthetic Antisense oligonucleotide
  misc_feature (1)..(2): bicyclic nucleic acid (BNA)
aacaucaaggaaga

SEQ ID NO: 3026 - RNA, 13 nt, Artificial Sequence
  Description of Artificial Sequence: Synthetic Antisense oligonucleotide
  misc_feature (1)..(2): bicyclic nucleic acid (BNA)
aacaucaaggaag

SEQ ID NO: 3027 - RNA, 25 nt, Artificial Sequence
  Description of Artificial Sequence: Synthetic Antisense oligonucleotide
  misc_feature (1)..(2): bicyclic nucleic acid (BNA)
acaucaaggaagauggcauuucuag

SEQ ID NO: 3028 - RNA, 24 nt, Artificial Sequence
  Description of Artificial Sequence: Synthetic Antisense oligonucleotide
  misc_feature (1)..(2): bicyclic nucleic acid (BNA)
acaucaaggaagauggcauuucua

SEQ ID NO: 3029 - RNA, 23 nt, Artificial Sequence
  Description of Artificial Sequence: Synthetic Antisense oligonucleotide
  misc_feature (1)..(2): bicyclic nucleic acid (BNA)
acaucaaggaagauggcauuucu

SEQ ID NO: 3030 - RNA, 22 nt, Artificial Sequence
  Description of Artificial Sequence: Synthetic Antisense oligonucleotide
  misc_feature (1)..(2): bicyclic nucleic acid (BNA)
acaucaaggaagauggcauuuc

SEQ ID NO: 3031 - RNA, 21 nt, Artificial Sequence
  Description of Artificial Sequence: Synthetic Antisense oligonucleotide
  misc_feature (1)..(2): bicyclic nucleic acid (BNA)
acaucaaggaagauggcauuu

SEQ ID NO: 3032 - RNA, 20 nt, Artificial Sequence
  Description of Artificial Sequence: Synthetic Antisense oligonucleotide
  misc_feature (1)..(2): bicyclic nucleic acid (BNA)
acaucaaggaagauggcauu

SEQ ID NO: 3033 - RNA, 19 nt, Artificial Sequence
  Description of Artificial Sequence: Synthetic Antisense oligonucleotide
  misc_feature (1)..(2): bicyclic nucleic acid (BNA)
acaucaaggaagauggcau

SEQ ID NO: 3034 - RNA, 18 nt, Artificial Sequence
  Description of Artificial Sequence: Synthetic Antisense oligonucleotide
  misc_feature (1)..(2): bicyclic nucleic acid (BNA)
acaucaaggaagauggca

SEQ ID NO: 3035 - RNA, 17 nt, Artificial Sequence
  Description of Artificial Sequence: Synthetic Antisense oligonucleotide
  misc_feature (1)..(2): bicyclic nucleic acid (BNA)
acaucaaggaagauggc

SEQ ID NO: 3036 - RNA, 16 nt, Artificial Sequence
  Description of Artificial Sequence: Synthetic Antisense oligonucleotide
  misc_feature (1)..(2): bicyclic nucleic acid (BNA)
acaucaaggaagaugg

SEQ ID NO: 3037 - RNA, 15 nt, Artificial Sequence
  Description of Artificial Sequence: Synthetic Antisense oligonucleotide
  misc_feature (1)..(2): bicyclic nucleic acid (BNA)
acaucaaggaagaug

SEQ ID NO: 3038 - RNA, 14 nt, Artificial Sequence
  Description of Artificial Sequence: Synthetic Antisense oligonucleotide
  misc_feature (1)..(2): bicyclic nucleic acid (BNA)
acaucaaggaagau

SEQ ID NO: 3039 - RNA, 13 nt, Artificial Sequence
  Description of Artificial Sequence: Synthetic Antisense oligonucleotide
  misc_feature (1)..(2): bicyclic nucleic acid (BNA)
acaucaaggaaga

SEQ ID NO: 3040 - RNA, 12 nt, Artificial Sequence
  Description of Artificial Sequence: Synthetic Antisense oligonucleotide
  misc_feature (1)..(2): bicyclic nucleic acid (BNA)
acaucaaggaag

SEQ ID NO: 3041 - RNA, 24 nt, Artificial Sequence
  Description of Artificial Sequence: Synthetic Antisense oligonucleotide
  misc_feature (1)..(2): bicyclic nucleic acid (BNA)
caucaaggaagauggcauuucuag

SEQ ID NO: 3042 - RNA, 23 nt, Artificial Sequence
  Description of Artificial Sequence: Synthetic Antisense oligonucleotide
  misc_feature (1)..(2): bicyclic nucleic acid (BNA)
caucaaggaagauggcauuucua

SEQ ID NO: 3043 - RNA, 22 nt, Artificial Sequence
  Description of Artificial Sequence: Synthetic Antisense oligonucleotide
  misc_feature (1)..(2): bicyclic nucleic acid (BNA)
caucaaggaagauggcauuucu

SEQ ID NO: 3044 - RNA, 21 nt, Artificial Sequence
  Description of Artificial Sequence: Synthetic Antisense oligonucleotide
  misc_feature (1)..(2): bicyclic nucleic acid (BNA)
caucaaggaagauggcauuuc

SEQ ID NO: 3045 - RNA, 20 nt, Artificial Sequence
  Description of Artificial Sequence: Synthetic Antisense oligonucleotide
  misc_feature (1)..(2): bicyclic nucleic acid (BNA)
caucaaggaagauggcauuu

SEQ ID NO: 3046 - RNA, 19 nt, Artificial Sequence
  Description of Artificial Sequence: Synthetic Antisense oligonucleotide
  misc_feature (1)..(2): bicyclic nucleic acid (BNA)
caucaaggaagauggcauu

SEQ ID NO: 3047 - RNA, 18 nt, Artificial Sequence
  Description of Artificial Sequence: Synthetic Antisense oligonucleotide
  misc_feature (1)..(2): bicyclic nucleic acid (BNA)
caucaaggaagauggcau

SEQ ID NO: 3048 - RNA, 17 nt, Artificial Sequence
  Description of Artificial Sequence: Synthetic Antisense oligonucleotide
  misc_feature (1)..(2): bicyclic nucleic acid (BNA)
caucaaggaagauggca

SEQ ID NO: 3049 - RNA, 16 nt, Artificial Sequence
  Description of Artificial Sequence: Synthetic Antisense oligonucleotide
  misc_feature (1)..(2): bicyclic nucleic acid (BNA)
caucaaggaagauggc

SEQ ID NO: 3050 - RNA, 15 nt, Artificial Sequence
  Description of Artificial Sequence: Synthetic Antisense oligonucleotide
  misc_feature (1)..(2): bicyclic nucleic acid (BNA)
caucaaggaagaugg

SEQ ID NO: 3051 - RNA, 14 nt, Artificial Sequence
  Description of Artificial Sequence: Synthetic Antisense oligonucleotide
  misc_feature (1)..(2): bicyclic nucleic acid (BNA)
caucaaggaagaug

SEQ ID NO: 3052 - RNA, 13 nt, Artificial Sequence
  Description of Artificial Sequence: Synthetic Antisense oligonucleotide
  misc_feature (1)..(2): bicyclic nucleic acid (BNA)
caucaaggaagau

SEQ ID NO: 3053 - RNA, 12 nt, Artificial Sequence
  Description of Artificial Sequence: Synthetic Antisense oligonucleotide
  misc_feature (1)..(2): bicyclic nucleic acid (BNA)
caucaaggaaga

SEQ ID NO: 3054 - RNA, 11 nt, Artificial Sequence
  Description of Artificial Sequence: Synthetic Antisense oligonucleotide
  misc_feature (1)..(2): bicyclic nucleic acid (BNA)
caucaaggaag

SEQ ID NO: 3055 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
atcaaggaagauggcauuucuag

SEQ ID NO: 3056 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
atcaaggaagauggcauuucua

SEQ ID NO: 3057 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
atcaaggaagauggcauuucu

SEQ ID NO: 3058 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
atcaaggaagauggcauuuc

SEQ ID NO: 3059 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
atcaaggaagauggcauuu

SEQ ID NO: 3060 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
atcaaggaagauggcauu

SEQ ID NO: 3061 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
atcaaggaagauggcau

SEQ ID NO: 3062 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
atcaaggaagauggca

SEQ ID NO: 3063 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
atcaaggaagauggc

SEQ ID NO: 3064 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
atcaaggaagaugg

SEQ ID NO: 3065 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
atcaaggaagaug

SEQ ID NO: 3066 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
atcaaggaagau

SEQ ID NO: 3067 - DNA, 11 bp, Artificial Sequence
  Description of Artificial Sequence: Synthetic Antisense oligonucleotide
  misc_feature (1)..(2): bicyclic nucleic acid (BNA)
atcaaggaaga

SEQ ID NO: 3068 - DNA, 10 bp, Artificial Sequence
  Description of Artificial Sequence: Synthetic Antisense oligonucleotide
  misc_feature (1)..(2): bicyclic nucleic acid (BNA)
atcaaggaag

SEQ ID NO: 3069 - RNA, 18 nt, Artificial Sequence
  Description of Artificial Sequence: Synthetic Antisense oligonucleotide
  misc_feature (17)..(18): bicyclic nucleic acid (BNA)
gguaaguucuguccaagc

SEQ ID NO: 3070 - RNA, 18 nt, Artificial Sequence
  Description of Artificial Sequence: Synthetic Antisense oligonucleotide
  misc_feature (17)..(18): bicyclic nucleic acid (BNA)
guaaguucuguccaagcc

SEQ ID NO: 3071 - RNA, 18 nt, Artificial Sequence
  Description of Artificial Sequence: Synthetic Antisense oligonucleotide
  misc_feature (17)..(18): bicyclic nucleic acid (BNA)
agucgguaaguucugucc

SEQ ID NO: 3072 - RNA, 18 nt, Artificial Sequence
  Description of Artificial Sequence: Synthetic Antisense oligonucleotide
  misc_feature (17)..(18): bicyclic nucleic acid (BNA)
cuguccaagcccgguuga

SEQ ID NO: 3073 - RNA, 15 nt, Artificial Sequence
  Description of Artificial Sequence: Synthetic Antisense oligonucleotide
  misc_feature (14)..(15): bicyclic nucleic acid (BNA)
uaaguucuguccaag

SEQ ID NO: 3074 - RNA, 20 nt, Artificial Sequence
  Description of Artificial Sequence: Synthetic Antisense oligonucleotide
  misc_feature (19)..(20): bicyclic nucleic acid (BNA)
uucuguccaagcccgguuga

SEQ ID NO: 3075 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(19): bicyclic nucleic acid (BNA)
uucuguccaagcccggutg

SEQ ID NO: 3076 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(18): bicyclic nucleic acid (BNA)
uucuguccaagcccggtt

SEQ ID NO: 3077 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(17): bicyclic nucleic acid (BNA)
uucuguccaagcccggt

SEQ ID NO: 3078 - RNA, 16 nt, Artificial Sequence
  Description of Artificial Sequence: Synthetic Antisense oligonucleotide
  misc_feature (15)..(16): bicyclic nucleic acid (BNA)
uucuguccaagcccgg

SEQ ID NO: 3079 - RNA, 15 nt, Artificial Sequence
  Description of Artificial Sequence: Synthetic Antisense oligonucleotide
  misc_feature (14)..(15): bicyclic nucleic acid (BNA)
uucuguccaagcccg

SEQ ID NO: 3080 - RNA, 14 nt, Artificial Sequence
  Description of Artificial Sequence: Synthetic Antisense oligonucleotide
  misc_feature (13)..(14): bicyclic nucleic acid (BNA)
uucuguccaagccc

SEQ ID NO: 3081 - RNA, 13 nt, Artificial Sequence
  Description of Artificial Sequence: Synthetic Antisense oligonucleotide
  misc_feature (12)..(13): bicyclic nucleic acid (BNA)
uucuguccaagcc

SEQ ID NO: 3082 - RNA, 12 nt, Artificial Sequence
  Description of Artificial Sequence: Synthetic Antisense oligonucleotide
  misc_feature (11)..(12): bicyclic nucleic acid (BNA)
uucuguccaagc

SEQ ID NO: 3083 - RNA, 11 nt, Artificial Sequence
  Description of Artificial Sequence: Synthetic Antisense oligonucleotide
  misc_feature (10)..(11): bicyclic nucleic acid (BNA)
uucuguccaag

SEQ ID NO: 3084 - RNA, 10 nt, Artificial Sequence
  Description of Artificial Sequence: Synthetic Antisense oligonucleotide
  misc_feature (9)..(10): bicyclic nucleic acid (BNA)
uucuguccaa

SEQ ID NO: 3085 - RNA, 9 nt, Artificial Sequence
  Description of Artificial Sequence: Synthetic Antisense oligonucleotide
  misc_feature (8)..(9): bicyclic nucleic acid (BNA)
uucugucca

SEQ ID NO: 3086 - RNA, 8 nt, Artificial Sequence
  Description of Artificial Sequence: Synthetic Antisense oligonucleotide
  misc_feature (7)..(8): bicyclic nucleic acid (BNA)
uucugucc

SEQ ID NO: 3087 - RNA, 19 nt, Artificial Sequence
  Description of Artificial Sequence: Synthetic Antisense oligonucleotide
  misc_feature (18)..(19): bicyclic nucleic acid (BNA)
ucuguccaagcccgguuga

SEQ ID NO: 3088 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(18): bicyclic nucleic acid (BNA)
ucuguccaagcccggutg

SEQ ID NO: 3089 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(17): bicyclic nucleic acid (BNA)
ucuguccaagcccggtt

SEQ ID NO: 3090 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(16): bicyclic nucleic acid (BNA)
ucuguccaagcccggt

SEQ ID NO: 3091 - RNA, 15 nt, Artificial Sequence
  Description of Artificial Sequence: Synthetic Antisense oligonucleotide
  misc_feature (14)..(15): bicyclic nucleic acid (BNA)
ucuguccaagcccgg

SEQ ID NO: 3092 - RNA, 14 nt, Artificial Sequence
  Description of Artificial Sequence: Synthetic Antisense oligonucleotide
  misc_feature (13)..(14): bicyclic nucleic acid (BNA)
ucuguccaagcccg

SEQ ID NO: 3093 - RNA, 13 nt, Artificial Sequence
  Description of Artificial Sequence: Synthetic Antisense oligonucleotide
  misc_feature (12)..(13): bicyclic nucleic acid (BNA)
ucuguccaagccc

SEQ ID NO: 3094 - RNA, 12 nt, Artificial Sequence
  Description of Artificial Sequence: Synthetic Antisense oligonucleotide
  misc_feature (11)..(12): bicyclic nucleic acid (BNA)
ucuguccaagcc

SEQ ID NO: 3095 - RNA, 11 nt, Artificial Sequence
  Description of Artificial Sequence: Synthetic Antisense oligonucleotide
  misc_feature (10)..(11): bicyclic nucleic acid (BNA)
ucuguccaagc

SEQ ID NO: 3096 - RNA, 10 nt, Artificial Sequence
  Description of Artificial Sequence: Synthetic Antisense oligonucleotide
  misc_feature (9)..(10): bicyclic nucleic acid (BNA)
ucuguccaag

SEQ ID NO: 3097 - RNA, 9 nt, Artificial Sequence
  Description of Artificial Sequence: Synthetic Antisense oligonucleotide
  misc_feature (8)..(9): bicyclic nucleic acid (BNA)
ucuguccaa

SEQ ID NO: 3098 - RNA, 8 nt, Artificial Sequence
  Description of Artificial Sequence: Synthetic Antisense oligonucleotide
  misc_feature (7)..(8): bicyclic nucleic acid (BNA)
ucugucca

SEQ ID NO: 3099 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(17): bicyclic nucleic acid (BNA)
cuguccaagcccggutg

SEQ ID NO: 3100 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(16): bicyclic nucleic acid (BNA)
cuguccaagcccggtt

SEQ ID NO: 3101 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(15): bicyclic nucleic acid (BNA)
cuguccaagcccggt

SEQ ID NO: 3102 - RNA, 14 nt, Artificial Sequence
  Description of Artificial Sequence: Synthetic Antisense oligonucleotide
  misc_feature (13)..(14): bicyclic nucleic acid (BNA)
cuguccaagcccgg

SEQ ID NO: 3103 - RNA, 13 nt, Artificial Sequence
  Description of Artificial Sequence: Synthetic Antisense oligonucleotide
  misc_feature (12)..(13): bicyclic nucleic acid (BNA)
cuguccaagcccg

SEQ ID NO: 3104 - RNA, 12 nt, Artificial Sequence
  Description of Artificial Sequence: Synthetic Antisense oligonucleotide
  misc_feature (11)..(12): bicyclic nucleic acid (BNA)
cuguccaagccc

SEQ ID NO: 3105 - RNA, 11 nt, Artificial Sequence
  Description of Artificial Sequence: Synthetic Antisense oligonucleotide
  misc_feature (10)..(11): bicyclic nucleic acid (BNA)
cuguccaagcc

SEQ ID NO: 3106 - RNA, 10 nt, Artificial Sequence
  Description of Artificial Sequence: Synthetic Antisense oligonucleotide
  misc_feature (9)..(10): bicyclic nucleic acid (BNA)
cuguccaagc

SEQ ID NO: 3107 - RNA, 9 nt, Artificial Sequence
  Description of Artificial Sequence: Synthetic Antisense oligonucleotide
  misc_feature (8)..(9): bicyclic nucleic acid (BNA)
cuguccaag

SEQ ID NO: 3108 - RNA, 8 nt, Artificial Sequence
  Description of Artificial Sequence: Synthetic Antisense oligonucleotide
  misc_feature (7)..(8): bicyclic nucleic acid (BNA)
cuguccaa

SEQ ID NO: 3109 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(20): bicyclic nucleic acid (BNA)
guucuguccaagcccggutg

SEQ ID NO: 3110 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(19): bicyclic nucleic acid (BNA)
guucuguccaagcccggtt

SEQ ID NO: 3111 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(18): bicyclic nucleic acid (BNA)
guucuguccaagcccggt

SEQ ID NO: 3112 - RNA, 17 nt, Artificial Sequence
  Description of Artificial Sequence: Synthetic Antisense oligonucleotide
  misc_feature (16)..(17): bicyclic nucleic acid (BNA)
guucuguccaagcccgg

SEQ ID NO: 3113 - RNA, 16 nt, Artificial Sequence
  Description of Artificial Sequence: Synthetic Antisense oligonucleotide
  misc_feature (15)..(16): bicyclic nucleic acid (BNA)
guucuguccaagcccg

SEQ ID NO: 3114 - RNA, 15 nt, Artificial Sequence
  Description of Artificial Sequence: Synthetic Antisense oligonucleotide
  misc_feature (14)..(15): bicyclic nucleic acid (BNA)
guucuguccaagccc

SEQ ID NO: 3115 - RNA, 14 nt, Artificial Sequence
  Description of Artificial Sequence: Synthetic Antisense oligonucleotide
  misc_feature (13)..(14): bicyclic nucleic acid (BNA)
guucuguccaagcc

SEQ ID NO: 3116 - RNA, 13 nt, Artificial Sequence
  Description of Artificial Sequence: Synthetic Antisense oligonucleotide
  misc_feature (12)..(13): bicyclic nucleic acid (BNA)
guucuguccaagc

SEQ ID NO: 3117 - RNA, 12 nt, Artificial Sequence
  Description of Artificial Sequence: Synthetic Antisense oligonucleotide
  misc_feature (11)..(12): bicyclic nucleic acid (BNA)
guucuguccaag

SEQ ID NO: 3118 - RNA, 11 nt, Artificial Sequence
  Description of Artificial Sequence: Synthetic Antisense oligonucleotide
  misc_feature (10)..(11): bicyclic nucleic acid (BNA)
guucuguccaa

SEQ ID NO: 3119 - RNA, 10 nt, Artificial Sequence
  Description of Artificial Sequence: Synthetic Antisense oligonucleotide
  misc_feature (9)..(10): bicyclic nucleic acid (BNA)
guucugucca

SEQ ID NO: 3120 - RNA, 9 nt, Artificial Sequence
  Description of Artificial Sequence: Synthetic Antisense oligonucleotide
  misc_feature (8)..(9): bicyclic nucleic acid (BNA)
guucugucc

SEQ ID NO: 3121 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(8): bicyclic nucleic acid (BNA)
guucugtc

SEQ ID NO: 3122 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(20): bicyclic nucleic acid (BNA)
aguucuguccaagcccggtt

SEQ ID NO: 3123 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(19): bicyclic nucleic acid (BNA)
aguucuguccaagcccggt

SEQ ID NO: 3124 - RNA, 18 nt, Artificial Sequence
  Description of Artificial Sequence: Synthetic Antisense oligonucleotide
  misc_feature (17)..(18): bicyclic nucleic acid (BNA)
aguucuguccaagcccgg

SEQ ID NO: 3125 - RNA, 17 nt, Artificial Sequence
  Description of Artificial Sequence: Synthetic Antisense oligonucleotide
  misc_feature (16)..(17): bicyclic nucleic acid (BNA)
aguucuguccaagcccg

SEQ ID NO: 3126 - RNA, 16 nt, Artificial Sequence
  Description of Artificial Sequence: Synthetic Antisense oligonucleotide
  misc_feature (15)..(16): bicyclic nucleic acid (BNA)
aguucuguccaagccc

SEQ ID NO: 3127 - RNA, 15 nt, Artificial Sequence
  Description of Artificial Sequence: Synthetic Antisense oligonucleotide
  misc_feature (14)..(15): bicyclic nucleic acid (BNA)
aguucuguccaagcc

SEQ ID NO: 3128 - RNA, 14 nt, Artificial Sequence
  Description of Artificial Sequence: Synthetic Antisense oligonucleotide
  misc_feature (13)..(14): bicyclic nucleic acid (BNA)
aguucuguccaagc

SEQ ID NO: 3129 - RNA, 13 nt, Artificial Sequence
  Description of Artificial Sequence: Synthetic Antisense oligonucleotide
  misc_feature (12)..(13): bicyclic nucleic acid (BNA)
aguucuguccaag

SEQ ID NO: 3130 - RNA, 12 nt, Artificial Sequence
  Description of Artificial Sequence: Synthetic Antisense oligonucleotide
  misc_feature (11)..(12): bicyclic nucleic acid (BNA)
aguucuguccaa

SEQ ID NO: 3131 - RNA, 11 nt, Artificial Sequence
  Description of Artificial Sequence: Synthetic Antisense oligonucleotide
  misc_feature (10)..(11): bicyclic nucleic acid (BNA)
aguucugucca

SEQ ID NO: 3132 - RNA, 10 nt, Artificial Sequence
  Description of Artificial Sequence: Synthetic Antisense oligonucleotide
  misc_feature (9)..(10): bicyclic nucleic acid (BNA)
aguucugucc

SEQ ID NO: 3133 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(9): bicyclic nucleic acid (BNA)
aguucugtc

SEQ ID NO: 3134 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(8): bicyclic nucleic acid (BNA)
aguucugt

SEQ ID NO: 3135 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(20): bicyclic nucleic acid (BNA)
aaguucuguccaagcccggt

SEQ ID NO: 3136 - RNA, 19 nt, Artificial Sequence
  Description of Artificial Sequence: Synthetic Antisense oligonucleotide
  misc_feature (18)..(19): bicyclic nucleic acid (BNA)
aaguucuguccaagcccgg

SEQ ID NO: 3137 - RNA, 18 nt, Artificial Sequence
  Description of Artificial Sequence: Synthetic Antisense oligonucleotide
  misc_feature (17)..(18): bicyclic nucleic acid (BNA)
aaguucuguccaagcccg

SEQ ID NO: 3138 - RNA, 17 nt, Artificial Sequence
  Description of Artificial Sequence: Synthetic Antisense oligonucleotide
  misc_feature (16)..(17): bicyclic nucleic acid (BNA)
aaguucuguccaagccc

SEQ ID NO: 3139 - RNA, 16 nt, Artificial Sequence
  Description of Artificial Sequence: Synthetic Antisense oligonucleotide
  misc_feature (15)..(16): bicyclic nucleic acid (BNA)
aaguucuguccaagcc

SEQ ID NO: 3140 - RNA, 15 nt, Artificial Sequence
  Description of Artificial Sequence: Synthetic Antisense oligonucleotide
  misc_feature (14)..(15): bicyclic nucleic acid (BNA)
aaguucuguccaagc

SEQ ID NO: 3141 - RNA, 14 nt, Artificial Sequence
  Description of Artificial Sequence: Synthetic Antisense oligonucleotide
  misc_feature (13)..(14): bicyclic nucleic acid (BNA)
aaguucuguccaag

SEQ ID NO: 3142 - RNA, 13 nt, Artificial Sequence
  Description of Artificial Sequence: Synthetic Antisense oligonucleotide
  misc_feature (12)..(13): bicyclic nucleic acid (BNA)
aaguucuguccaa

SEQ ID NO: 3143 - RNA, 12 nt, Artificial Sequence
  Description of Artificial Sequence: Synthetic Antisense oligonucleotide
  misc_feature (11)..(12): bicyclic nucleic acid (BNA)
aaguucugucca

SEQ ID NO: 3144 - RNA, 11 nt, Artificial Sequence
  Description of Artificial Sequence: Synthetic Antisense oligonucleotide
  misc_feature (10)..(11): bicyclic nucleic acid (BNA)
aaguucugucc

SEQ ID NO: 3145 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(10): bicyclic nucleic acid (BNA)
aaguucugtc

SEQ ID NO: 3146 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(9): bicyclic nucleic acid (BNA)
aaguucugt

SEQ ID NO: 3147 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(8): bicyclic nucleic acid (BNA)
aaguuctg

SEQ ID NO: 3148 - RNA, 20 nt, Artificial Sequence
  Description of Artificial Sequence: Synthetic Antisense oligonucleotide
  misc_feature (19)..(20): bicyclic nucleic acid (BNA)
uaaguucuguccaagcccgg

SEQ ID NO: 3149 - RNA, 19 nt, Artificial Sequence
  Description of Artificial Sequence: Synthetic Antisense oligonucleotide
  misc_feature (18)..(19): bicyclic nucleic acid (BNA)
uaaguucuguccaagcccg

SEQ ID NO: 3150 - RNA, 18 nt, Artificial Sequence
  Description of Artificial Sequence: Synthetic Antisense oligonucleotide
  misc_feature (17)..(18): bicyclic nucleic acid (BNA)
uaaguucuguccaagccc

SEQ ID NO: 3151 - RNA, 17 nt, Artificial Sequence
  Description of Artificial Sequence: Synthetic Antisense oligonucleotide
  misc_feature (16)..(17): bicyclic nucleic acid (BNA)
uaaguucuguccaagcc

SEQ ID NO: 3152 - RNA, 16 nt, Artificial Sequence
  Description of Artificial Sequence: Synthetic Antisense oligonucleotide
  misc_feature (15)..(16): bicyclic nucleic acid (BNA)
uaaguucuguccaagc

SEQ ID NO: 3153 - RNA, 14 nt, Artificial Sequence
  Description of Artificial Sequence: Synthetic Antisense oligonucleotide
  misc_feature (13)..(14): bicyclic nucleic acid (BNA)
uaaguucuguccaa

SEQ ID NO: 3154 - RNA, 13 nt, Artificial Sequence
  Description of Artificial Sequence: Synthetic Antisense oligonucleotide
  misc_feature (12)..(13): bicyclic nucleic acid (BNA)
uaaguucugucca

SEQ ID NO: 3155 - RNA, 12 nt, Artificial Sequence
  Description of Artificial Sequence: Synthetic Antisense oligonucleotide
  misc_feature (11)..(12): bicyclic nucleic acid (BNA)
uaaguucugucc

SEQ ID NO: 3156 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(11): bicyclic nucleic acid (BNA)
uaaguucugtc

SEQ ID NO: 3157 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(10): bicyclic nucleic acid (BNA)
uaaguucugt

SEQ ID NO: 3158 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(9): bicyclic nucleic acid (BNA)
uaaguuctg

SEQ ID NO: 3159 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(8): bicyclic nucleic acid (BNA)
uaaguuct

SEQ ID NO: 3160 - RNA, 20 nt, Artificial Sequence
  Description of Artificial Sequence: Synthetic Antisense oligonucleotide
  misc_feature (19)..(20): bicyclic nucleic acid (BNA)
guaaguucuguccaagcccg

SEQ ID NO: 3161 - RNA, 19 nt, Artificial Sequence
  Description of Artificial Sequence: Synthetic Antisense oligonucleotide
  misc_feature (18)..(19): bicyclic nucleic acid (BNA)
guaaguucuguccaagccc

SEQ ID NO: 3162 - RNA, 17 nt, Artificial Sequence
  Description of Artificial Sequence: Synthetic Antisense oligonucleotide
  misc_feature (16)..(17): bicyclic nucleic acid (BNA)
guaaguucuguccaagc

SEQ ID NO: 3163 - RNA, 16 nt, Artificial Sequence
  Description of Artificial Sequence: Synthetic Antisense oligonucleotide
  misc_feature (15)..(16): bicyclic nucleic acid (BNA)
guaaguucuguccaag

SEQ ID NO: 3164 - RNA, 15 nt, Artificial Sequence
  Description of Artificial Sequence: Synthetic Antisense oligonucleotide
  misc_feature (14)..(15): bicyclic nucleic acid (BNA)
guaaguucuguccaa

SEQ ID NO: 3165 - RNA, 14 nt, Artificial Sequence
  Description of Artificial Sequence: Synthetic Antisense oligonucleotide
  misc_feature (13)..(14): bicyclic nucleic acid (BNA)
guaaguucugucca

SEQ ID NO: 3166 - RNA, 13 nt, Artificial Sequence
  Description of Artificial Sequence: Synthetic Antisense oligonucleotide
  misc_feature (12)..(13): bicyclic nucleic acid (BNA)
guaaguucugucc

SEQ ID NO: 3167 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(12): bicyclic nucleic acid (BNA)
guaaguucugtc

SEQ ID NO: 3168 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(11): bicyclic nucleic acid (BNA)
guaaguucugt

SEQ ID NO: 3169 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(10): bicyclic nucleic acid (BNA)
guaaguuctg

SEQ ID NO: 3170 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(9): bicyclic nucleic acid (BNA)
guaaguuct

SEQ ID NO: 3171 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(8): bicyclic nucleic acid (BNA)
guaagutc

SEQ ID NO: 3172 - RNA, 20 nt, Artificial Sequence
  Description of Artificial Sequence: Synthetic Antisense oligonucleotide
  misc_feature (19)..(20): bicyclic nucleic acid (BNA)
gguaaguucuguccaagccc

SEQ ID NO: 3173 - RNA, 19 nt, Artificial Sequence
  Description of Artificial Sequence: Synthetic Antisense oligonucleotide
  misc_feature (18)..(19): bicyclic nucleic acid (BNA)
gguaaguucuguccaagcc

SEQ ID NO: 3174 - RNA, 17 nt, Artificial Sequence
  Description of Artificial Sequence: Synthetic Antisense oligonucleotide
  misc_feature (16)..(17): bicyclic nucleic acid (BNA)
gguaaguucuguccaag

SEQ ID NO: 3175 - RNA, 16 nt, Artificial Sequence
  Description of Artificial Sequence: Synthetic Antisense oligonucleotide
  misc_feature (15)..(16): bicyclic nucleic acid (BNA)
gguaaguucuguccaa

SEQ ID NO: 3176 - RNA, 15 nt, Artificial Sequence
  Description of Artificial Sequence: Synthetic Antisense oligonucleotide
  misc_feature (14)..(15): bicyclic nucleic acid (BNA)
gguaaguucugucca

SEQ ID NO: 3177 - RNA, 14 nt, Artificial Sequence
  Description of Artificial Sequence: Synthetic Antisense oligonucleotide
  misc_feature (13)..(14): bicyclic nucleic acid (BNA)
gguaaguucugucc

SEQ ID NO: 3178 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(13): bicyclic nucleic acid (BNA)
gguaaguucugtc

SEQ ID NO: 3179 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(12): bicyclic nucleic acid (BNA)
gguaaguucugt

SEQ ID NO: 3180 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(11): bicyclic nucleic acid (BNA)
gguaaguuctg

SEQ ID NO: 3181 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(10): bicyclic nucleic acid (BNA)
gguaaguuct

SEQ ID NO: 3182 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(9): bicyclic nucleic acid (BNA)
gguaagutc

SEQ ID NO: 3183 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(8): bicyclic nucleic acid (BNA)
gguaagtt

SEQ ID NO: 3184 - RNA, 20 nt, Artificial Sequence
  Description of Artificial Sequence: Synthetic Antisense oligonucleotide
  misc_feature (19)..(20): bicyclic nucleic acid (BNA)
cgguaaguucuguccaagcc

SEQ ID NO: 3185 - RNA, 19 nt, Artificial Sequence
  Description of Artificial Sequence: Synthetic Antisense oligonucleotide
  misc_feature (18)..(19): bicyclic nucleic acid (BNA)
cgguaaguucuguccaagc

SEQ ID NO: 3186 - RNA, 18 nt, Artificial Sequence
  Description of Artificial Sequence: Synthetic Antisense oligonucleotide
  misc_feature (17)..(18): bicyclic nucleic acid (BNA)
cgguaaguucuguccaag

SEQ ID NO: 3187 - RNA, 17 nt, Artificial Sequence
  Description of Artificial Sequence: Synthetic Antisense oligonucleotide
  misc_feature (16)..(17): bicyclic nucleic acid (BNA)
cgguaaguucuguccaa

SEQ ID NO: 3188 - RNA, 16 nt, Artificial Sequence
  Description of Artificial Sequence: Synthetic Antisense oligonucleotide
  misc_feature (15)..(16): bicyclic nucleic acid (BNA)
cgguaaguucugucca

SEQ ID NO: 3189 - RNA, 15 nt, Artificial Sequence
  Description of Artificial Sequence: Synthetic Antisense oligonucleotide
  misc_feature (14)..(15): bicyclic nucleic acid (BNA)
cgguaaguucugucc

SEQ ID NO: 3190 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(14): bicyclic nucleic acid (BNA)
cgguaaguucugtc

SEQ ID NO: 3191 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(13): bicyclic nucleic acid (BNA)
cgguaaguucugt

SEQ ID NO: 3192 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(12): bicyclic nucleic acid (BNA)
cgguaaguuctg

SEQ ID NO: 3193 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(11): bicyclic nucleic acid (BNA)
cgguaaguuct

SEQ ID NO: 3194 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(10): bicyclic nucleic acid (BNA)
cgguaagutc

SEQ ID NO: 3195 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(9): bicyclic nucleic acid (BNA)
cgguaagtt

SEQ ID NO: 3196 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(8): bicyclic nucleic acid (BNA)
cgguaagt

SEQ ID NO: 3197 - RNA, 20 nt, Artificial Sequence
  Description of Artificial Sequence: Synthetic Antisense oligonucleotide
  misc_feature (19)..(20): bicyclic nucleic acid (BNA)
ucgguaaguucuguccaagc

SEQ ID NO: 3198 - RNA, 19 nt, Artificial Sequence
  Description of Artificial Sequence: Synthetic Antisense oligonucleotide
  misc_feature (18)..(19): bicyclic nucleic acid (BNA)
ucgguaaguucuguccaag

SEQ ID NO: 3199 - RNA, 18 nt, Artificial Sequence
  Description of Artificial Sequence: Synthetic Antisense oligonucleotide
  misc_feature (17)..(18): bicyclic nucleic acid (BNA)
ucgguaaguucuguccaa

SEQ ID NO: 3200 - RNA, 17 nt, Artificial Sequence
  Description of Artificial Sequence: Synthetic Antisense oligonucleotide
  misc_feature (16)..(17): bicyclic nucleic acid (BNA)
ucgguaaguucugucca

SEQ ID NO: 3201 - RNA, 16 nt, Artificial Sequence
  Description of Artificial Sequence: Synthetic Antisense oligonucleotide
  misc_feature (15)..(16): bicyclic nucleic acid (BNA)
ucgguaaguucugucc

SEQ ID NO: 3202 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(15): bicyclic nucleic acid (BNA)
ucgguaaguucugtc

SEQ ID NO: 3203 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(14): bicyclic nucleic acid (BNA)
ucgguaaguucugt

SEQ ID NO: 3204 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(13): bicyclic nucleic acid (BNA)
ucgguaaguuctg

SEQ ID NO: 3205 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(12): bicyclic nucleic acid (BNA)
ucgguaaguuct

SEQ ID NO: 3206 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(11): bicyclic nucleic acid (BNA)
ucgguaagutc

SEQ ID NO: 3207 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(10): bicyclic nucleic acid (BNA)
ucgguaagtt

SEQ ID NO: 3208 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(9): bicyclic nucleic acid (BNA)
ucgguaagt

SEQ ID NO: 3209 - RNA, 20 nt, Artificial Sequence
  Description of Artificial Sequence: Synthetic Antisense oligonucleotide
  misc_feature (19)..(20): bicyclic nucleic acid (BNA)
gucgguaaguucuguccaag

SEQ ID NO: 3210 - RNA, 19 nt, Artificial Sequence
  Description of Artificial Sequence: Synthetic Antisense oligonucleotide
  misc_feature (18)..(19): bicyclic nucleic acid (BNA)
gucgguaaguucuguccaa

SEQ ID NO: 3211 - RNA, 18 nt, Artificial Sequence
  Description of Artificial Sequence: Synthetic Antisense oligonucleotide
  misc_feature (17)..(18): bicyclic nucleic acid (BNA)
gucgguaaguucugucca

SEQ ID NO: 3212 - RNA, 17 nt, Artificial Sequence
  Description of Artificial Sequence: Synthetic Antisense oligonucleotide
  misc_feature (16)..(17): bicyclic nucleic acid (BNA)
gucgguaaguucugucc

SEQ ID NO: 3213 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(16): bicyclic nucleic acid (BNA)
gucgguaaguucugtc

SEQ ID NO: 3214 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(15): bicyclic nucleic acid (BNA)
gucgguaaguucugt

SEQ ID NO: 3215 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(14): bicyclic nucleic acid (BNA)
gucgguaaguuctg

SEQ ID NO: 3216 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(13): bicyclic nucleic acid (BNA)
gucgguaaguuct

SEQ ID NO: 3217 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(12): bicyclic nucleic acid (BNA)
gucgguaagutc

SEQ ID NO: 3218 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(11): bicyclic nucleic acid (BNA)
gucgguaagtt

SEQ ID NO: 3219 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(10): bicyclic nucleic acid (BNA)
gucgguaagt

SEQ ID NO: 3220 - RNA, 20 nt, Artificial Sequence
  Description of Artificial Sequence: Synthetic Antisense oligonucleotide
  misc_feature (19)..(20): bicyclic nucleic acid (BNA)
agucgguaaguucuguccaa

SEQ ID NO: 3221 - RNA, 19 nt, Artificial Sequence
  Description of Artificial Sequence: Synthetic Antisense oligonucleotide
  misc_feature (18)..(19): bicyclic nucleic acid (BNA)
agucgguaaguucugucca

SEQ ID NO: 3222 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(17): bicyclic nucleic acid (BNA)
agucgguaaguucugtc

SEQ ID NO: 3223 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(16): bicyclic nucleic acid (BNA)
agucgguaaguucugt

SEQ ID NO: 3224 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(15): bicyclic nucleic acid (BNA)
agucgguaaguuctg

SEQ ID NO: 3225 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(14): bicyclic nucleic acid (BNA)
agucgguaaguuct

SEQ ID NO: 3226 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(13): bicyclic nucleic acid (BNA)
agucgguaagutc

SEQ ID NO: 3227 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(12): bicyclic nucleic acid (BNA)
agucgguaagtt

SEQ ID NO: 3228 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(11): bicyclic nucleic acid (BNA)
agucgguaagt

SEQ ID NO: 3229 - RNA, 20 nt, Artificial Sequence
  Description of Artificial Sequence: Synthetic Antisense oligonucleotide
  misc_feature (19)..(20): bicyclic nucleic acid (BNA)
cagucgguaaguucugucca

SEQ ID NO: 3230 - RNA, 19 nt, Artificial Sequence
  Description of Artificial Sequence: Synthetic Antisense oligonucleotide
  misc_feature (18)..(19): bicyclic nucleic acid (BNA)
cagucgguaaguucugucc

SEQ ID NO: 3231 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(18): bicyclic nucleic acid (BNA)
cagucgguaaguucugtc

SEQ ID NO: 3232 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(17): bicyclic nucleic acid (BNA)
cagucgguaaguucugt

SEQ ID NO: 3233 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(16): bicyclic nucleic acid (BNA)
cagucgguaaguuctg

SEQ ID NO: 3234 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(15): bicyclic nucleic acid (BNA)
cagucgguaaguuct

SEQ ID NO: 3235 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(14): bicyclic nucleic acid (BNA)
cagucgguaagutc

SEQ ID NO: 3236 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(13): bicyclic nucleic acid (BNA)
cagucgguaagtt

SEQ ID NO: 3237 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(12): bicyclic nucleic acid (BNA)
cagucgguaagt

SEQ ID NO: 3238 - RNA, 20 nt, Artificial Sequence
  Description of Artificial Sequence: Synthetic Antisense oligonucleotide
  misc_feature (19)..(20): bicyclic nucleic acid (BNA)
ccagucgguaaguucugucc

SEQ ID NO: 3239 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(19): bicyclic nucleic acid (BNA)
ccagucgguaaguucugtc

SEQ ID NO: 3240 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(18): bicyclic nucleic acid (BNA)
ccagucgguaaguucugt

SEQ ID NO: 3241 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(17): bicyclic nucleic acid (BNA)
ccagucgguaaguuctg

SEQ ID NO: 3242 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(16): bicyclic nucleic acid (BNA)
ccagucgguaaguuct

SEQ ID NO: 3243 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(15): bicyclic nucleic acid (BNA)
ccagucgguaagutc

SEQ ID NO: 3244 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(14): bicyclic nucleic acid (BNA)
ccagucgguaagtt

SEQ ID NO: 3245 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(13): bicyclic nucleic acid (BNA)
ccagucgguaagt

SEQ ID NO: 3246 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(20): bicyclic nucleic acid (BNA)
gccagucgguaaguucugtc

SEQ ID NO: 3247 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(19): bicyclic nucleic acid (BNA)
gccagucgguaaguucugt

SEQ ID NO: 3248 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(18): bicyclic nucleic acid (BNA)
gccagucgguaaguuctg

SEQ ID NO: 3249 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(17): bicyclic nucleic acid (BNA)
gccagucgguaaguuct

SEQ ID NO: 3250 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(16): bicyclic nucleic acid (BNA)
gccagucgguaagutc

SEQ ID NO: 3251 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(15): bicyclic nucleic acid (BNA)
gccagucgguaagtt

SEQ ID NO: 3252 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(14): bicyclic nucleic acid (BNA)
gccagucgguaagt

SEQ ID NO: 3253 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(20): bicyclic nucleic acid (BNA)
ucaaggaagauggcauuuct

SEQ ID NO: 3254 - RNA, 22 nt, Artificial Sequence
  Description of Artificial Sequence: Synthetic Antisense oligonucleotide
  misc_feature (21)..(22): bicyclic nucleic acid (BNA)
ucaaggaagauggcauuucuag

SEQ ID NO: 3255 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(16): bicyclic nucleic acid (BNA)
ucaaggaagauggcat

SEQ ID NO: 3256 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(15): bicyclic nucleic acid (BNA)
gaagauggcauuuct

SEQ ID NO: 3257 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (20)..(21): bicyclic nucleic acid (BNA)
ucaaggaagauggcauuucta

SEQ ID NO: 3258 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(19): bicyclic nucleic acid (BNA)
ucaaggaagauggcauutc

SEQ ID NO: 3259 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(18): bicyclic nucleic acid (BNA)
ucaaggaagauggcautt

SEQ ID NO: 3260 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(17): bicyclic nucleic acid (BNA)
ucaaggaagauggcatt

SEQ ID NO: 3261 - RNA, 15 nt, Artificial Sequence
  Description of Artificial Sequence: Synthetic Antisense oligonucleotide
  misc_feature (14)..(15): bicyclic nucleic acid (BNA)
ucaaggaagauggca

SEQ ID NO: 3262 - RNA, 14 nt, Artificial Sequence
  Description of Artificial Sequence: Synthetic Antisense oligonucleotide
  misc_feature (13)..(14): bicyclic nucleic acid (BNA)
ucaaggaagauggc

SEQ ID NO: 3263 - RNA, 13 nt, Artificial Sequence
  Description of Artificial Sequence: Synthetic Antisense oligonucleotide
  misc_feature (12)..(13): bicyclic nucleic acid (BNA)
ucaaggaagaugg

SEQ ID NO: 3264 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(12): bicyclic nucleic acid (BNA)
ucaaggaagatg

SEQ ID NO: 3265 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(11): bicyclic nucleic acid (BNA)
ucaaggaagat

SEQ ID NO: 3266 - RNA, 10 nt, Artificial Sequence
  Description of Artificial Sequence: Synthetic Antisense oligonucleotide
  misc_feature (9)..(10): bicyclic nucleic acid (BNA)
ucaaggaaga

SEQ ID NO: 3267 - RNA, 9 nt, Artificial Sequence
  Description of Artificial Sequence: Synthetic Antisense oligonucleotide
  misc_feature (8)..(9): bicyclic nucleic acid (BNA)
ucaaggaag

SEQ ID NO: 3268 - RNA, 21 nt, Artificial Sequence
  Description of Artificial Sequence: Synthetic Antisense oligonucleotide
  misc_feature (20)..(21): bicyclic nucleic acid (BNA)
caaggaagauggcauuucuag

SEQ ID NO: 3269 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(20): bicyclic nucleic acid (BNA)
caaggaagauggcauuucta

SEQ ID NO: 3270 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(19): bicyclic nucleic acid (BNA)
caaggaagauggcauuuct

SEQ ID NO: 3271 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(18): bicyclic nucleic acid (BNA)
caaggaagauggcauutc

SEQ ID NO: 3272 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(17): bicyclic nucleic acid (BNA)
caaggaagauggcautt

SEQ ID NO: 3273 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(16): bicyclic nucleic acid (BNA)
caaggaagauggcatt

SEQ ID NO: 3274 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(15): bicyclic nucleic acid (BNA)
caaggaagauggcat

SEQ ID NO: 3275 - RNA, 14 nt, Artificial Sequence
  Description of Artificial Sequence: Synthetic Antisense oligonucleotide
  misc_feature (13)..(14): bicyclic nucleic acid (BNA)
caaggaagauggca

SEQ ID NO: 3276 - RNA, 13 nt, Artificial Sequence
  Description of Artificial Sequence: Synthetic Antisense oligonucleotide
  misc_feature (12)..(13): bicyclic nucleic acid (BNA)
caaggaagauggc

SEQ ID NO: 3277 - RNA, 12 nt, Artificial Sequence
  Description of Artificial Sequence: Synthetic Antisense oligonucleotide
  misc_feature (11)..(12): bicyclic nucleic acid (BNA)
caaggaagaugg

SEQ ID NO: 3278 - DNA, 11 bp, Artificial Sequence
  Description of Artificial Sequence: Synthetic Antisense oligonucleotide
  misc_feature (10)..(11): bicyclic nucleic acid (BNA)
caaggaagatg

SEQ ID NO: 3279 - DNA, 10 bp, Artificial Sequence
  Description of Artificial Sequence: Synthetic Antisense oligonucleotide
  misc_feature (9)..(10): bicyclic nucleic acid (BNA)
caaggaagat

SEQ ID NO: 3280 - RNA, 9 nt, Artificial Sequence
  Description of Artificial Sequence: Synthetic Antisense oligonucleotide
  misc_feature (8)..(9): bicyclic nucleic acid (BNA)
caaggaaga

SEQ ID NO: 3281 - RNA, 8 nt, Artificial Sequence
  Description of Artificial Sequence: Synthetic Antisense oligonucleotide
  misc_feature (7)..(8): bicyclic nucleic acid (BNA)
caaggaag

SEQ ID NO: 3282 - RNA, 20 nt, Artificial Sequence
  Description of Artificial Sequence: Synthetic Antisense oligonucleotide
  misc_feature (19)..(20): bicyclic nucleic acid (BNA)
aaggaagauggcauuucuag

SEQ ID NO: 3283 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(19): bicyclic nucleic acid (BNA)
aaggaagauggcauuucta

SEQ ID NO: 3284 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(18): bicyclic nucleic acid (BNA)
aaggaagauggcauuuct

SEQ ID NO: 3285 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(17): bicyclic nucleic acid (BNA)
aaggaagauggcauutc

SEQ ID NO: 3286 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(16): bicyclic nucleic acid (BNA)
aaggaagauggcautt

SEQ ID NO: 3287 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(15): bicyclic nucleic acid (BNA)
aaggaagauggcatt

SEQ ID NO: 3288 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(14): bicyclic nucleic acid (BNA)
aaggaagauggcat

SEQ ID NO: 3289 - RNA, 13 nt, Artificial Sequence
  Description of Artificial Sequence: Synthetic Antisense oligonucleotide
  misc_feature (12)..(13): bicyclic nucleic acid (BNA)
aaggaagauggca

SEQ ID NO: 3290 - RNA, 12 nt, Artificial Sequence
  Description of Artificial Sequence: Synthetic Antisense oligonucleotide
  misc_feature (11)..(12): bicyclic nucleic acid (BNA)
aaggaagauggc

SEQ ID NO: 3291 - RNA, 11 nt, Artificial Sequence
  Description of Artificial Sequence: Synthetic Antisense oligonucleotide
  misc_feature (10)..(11): bicyclic nucleic acid (BNA)
aaggaagaugg

SEQ ID NO: 3292 - DNA, 10 bp, Artificial Sequence
  Description of Artificial Sequence: Synthetic Antisense oligonucleotide
  misc_feature (9)..(10): bicyclic nucleic acid (BNA)
aaggaagatg

SEQ ID NO: 3293 - DNA, 9 bp, Artificial Sequence
  Description of Artificial Sequence: Synthetic Antisense oligonucleotide
  misc_feature (8)..(9): bicyclic nucleic acid (BNA)
aaggaagat

SEQ ID NO: 3294 - RNA, 8 nt, Artificial Sequence
  Description of Artificial Sequence: Synthetic Antisense oligonucleotide
  misc_feature (7)..(8): bicyclic nucleic acid (BNA)
aaggaaga

SEQ ID NO: 3295 - RNA, 19 nt, Artificial Sequence
  Description of Artificial Sequence: Synthetic Antisense oligonucleotide
  misc_feature (18)..(19): bicyclic nucleic acid (BNA)
aggaagauggcauuucuag

SEQ ID NO: 3296 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(18): bicyclic nucleic acid (BNA)
aggaagauggcauuucta

SEQ ID NO: 3297 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(17): bicyclic nucleic acid (BNA)
aggaagauggcauuuct

SEQ ID NO: 3298 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(16): bicyclic nucleic acid (BNA)
aggaagauggcauutc

SEQ ID NO: 3299 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(15): bicyclic nucleic acid (BNA)
aggaagauggcautt

SEQ ID NO: 3300 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(14): bicyclic nucleic acid (BNA)
aggaagauggcatt

SEQ ID NO: 3301 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(13): bicyclic nucleic acid (BNA)
aggaagauggcat

SEQ ID NO: 3302 - RNA, 12 nt, Artificial Sequence
  Description of Artificial Sequence: Synthetic Antisense oligonucleotide
  misc_feature (11)..(12): bicyclic nucleic acid (BNA)
aggaagauggca

SEQ ID NO: 3303 - RNA, 10 nt, Artificial Sequence
  Description of Artificial Sequence: Synthetic Antisense oligonucleotide
  misc_feature (9)..(10): bicyclic nucleic acid (BNA)
aggaagaugg

SEQ ID NO: 3304 - DNA, 9 bp, Artificial Sequence
  Description of Artificial Sequence: Synthetic Antisense oligonucleotide
  misc_feature (8)..(9): bicyclic nucleic acid (BNA)
aggaagatg

SEQ ID NO: 3305 - DNA, 8 bp, Artificial Sequence
  Description of Artificial Sequence: Synthetic Antisense oligonucleotide
  misc_feature (7)..(8): bicyclic nucleic acid (BNA)
aggaagat

SEQ ID NO: 3306 - RNA, 18 nt, Artificial Sequence
  Description of Artificial Sequence: Synthetic Antisense oligonucleotide
  misc_feature (17)..(18): bicyclic nucleic acid (BNA)
ggaagauggcauuucuag

SEQ ID NO: 3307 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(17): bicyclic nucleic acid (BNA)
ggaagauggcauuucta

SEQ ID NO: 3308 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(16): bicyclic nucleic acid (BNA)
ggaagauggcauuuct

SEQ ID NO: 3309 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(15): bicyclic nucleic acid (BNA)
ggaagauggcauutc

SEQ ID NO: 3310 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(14): bicyclic nucleic acid (BNA)
ggaagauggcautt

SEQ ID NO: 3311 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(13): bicyclic nucleic acid (BNA)
ggaagauggcatt

SEQ ID NO: 3312 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(12): bicyclic nucleic acid (BNA)
ggaagauggcat

SEQ ID NO: 3313 - RNA, 11 nt, Artificial Sequence
  Description of Artificial Sequence: Synthetic Antisense oligonucleotide
  misc_feature (10)..(11): bicyclic nucleic acid (BNA)
ggaagauggca

SEQ ID NO: 3314 - RNA, 10 nt, Artificial Sequence
  Description of Artificial Sequence: Synthetic Antisense oligonucleotide
  misc_feature (9)..(10): bicyclic nucleic acid (BNA)
ggaagauggc

SEQ ID NO: 3315 - DNA, 8 bp, Artificial Sequence
  Description of Artificial Sequence: Synthetic Antisense oligonucleotide
  misc_feature (7)..(8): bicyclic nucleic acid (BNA)
ggaagatg

SEQ ID NO: 3316 - RNA, 17 nt, Artificial Sequence
  Description of Artificial Sequence: Synthetic Antisense oligonucleotide
  misc_feature (16)..(17): bicyclic nucleic acid (BNA)
gaagauggcauuucuag

SEQ ID NO: 3317 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(16): bicyclic nucleic acid (BNA)
gaagauggcauuucta

SEQ ID NO: 3318 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(14): bicyclic nucleic acid (BNA)
gaagauggcauutc

SEQ ID NO: 3319 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(13): bicyclic nucleic acid (BNA)
gaagauggcautt

SEQ ID NO: 3320 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(12): bicyclic nucleic acid (BNA)
gaagauggcatt

SEQ ID NO: 3321 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(11): bicyclic nucleic acid (BNA)
gaagauggcat

SEQ ID NO: 3322 - RNA, 10 nt, Artificial Sequence
  Description of Artificial Sequence: Synthetic Antisense oligonucleotide
  misc_feature (9)..(10): bicyclic nucleic acid (BNA)
gaagauggca

SEQ ID NO: 3323 - RNA, 9 nt, Artificial Sequence
  Description of Artificial Sequence: Synthetic Antisense oligonucleotide
  misc_feature (8)..(9): bicyclic nucleic acid (BNA)
gaagauggc

SEQ ID NO: 3324 - RNA, 8 nt, Artificial Sequence
  Description of Artificial Sequence: Synthetic Antisense oligonucleotide
  misc_feature (7)..(8): bicyclic nucleic acid (BNA)
gaagaugg

SEQ ID NO: 3325 - RNA, 16 nt, Artificial Sequence
  Description of Artificial Sequence: Synthetic Antisense oligonucleotide
  misc_feature (15)..(16): bicyclic nucleic acid (BNA)
aagauggcauuucuag

SEQ ID NO: 3326 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(15): bicyclic nucleic acid (BNA)
aagauggcauuucta

SEQ ID NO: 3327 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(14): bicyclic nucleic acid (BNA)
aagauggcauuuct

SEQ ID NO: 3328 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(13): bicyclic nucleic acid (BNA)
aagauggcauutc

SEQ ID NO: 3329 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(12): bicyclic nucleic acid (BNA)
aagauggcautt

SEQ ID NO: 3330 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(11): bicyclic nucleic acid (BNA)
aagauggcatt

SEQ ID NO: 3331 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(10): bicyclic nucleic acid (BNA)
aagauggcat

SEQ ID NO: 3332 - RNA, 9 nt, Artificial Sequence
  Description of Artificial Sequence: Synthetic Antisense oligonucleotide
  misc_feature (8)..(9): bicyclic nucleic acid (BNA)
aagauggca

SEQ ID NO: 3333 - RNA, 8 nt, Artificial Sequence
  Description of Artificial Sequence: Synthetic Antisense oligonucleotide
  misc_feature (7)..(8): bicyclic nucleic acid (BNA)
aagauggc

SEQ ID NO: 3334 - RNA, 15 nt, Artificial Sequence
  Description of Artificial Sequence: Synthetic Antisense oligonucleotide
  misc_feature (14)..(15): bicyclic nucleic acid (BNA)
agauggcauuucuag

SEQ ID NO: 3335 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(14): bicyclic nucleic acid (BNA)
agauggcauuucta

SEQ ID NO: 3336 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(13): bicyclic nucleic acid (BNA)
agauggcauuuct

SEQ ID NO: 3337 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(12): bicyclic nucleic acid (BNA)
agauggcauutc

SEQ ID NO: 3338 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(11): bicyclic nucleic acid (BNA)
agauggcautt

SEQ ID NO: 3339 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(10): bicyclic nucleic acid (BNA)
agauggcatt

SEQ ID NO: 3340 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(9): bicyclic nucleic acid (BNA)
agauggcat

SEQ ID NO: 3341 - RNA, 8 nt, Artificial Sequence
  Description of Artificial Sequence: Synthetic Antisense oligonucleotide
  misc_feature (7)..(8): bicyclic nucleic acid (BNA)
agauggca

SEQ ID NO: 3342 - RNA, 30 nt, Artificial Sequence; identical to SEQ ID NO: 287
  Description of Artificial Sequence: Synthetic Antisense oligonucleotide
  misc_feature (29)..(30): bicyclic nucleic acid (BNA)

SEQ ID NO: 3343 - DNA, 29 bp, Artificial Sequence
  Description of Artificial Sequence: Synthetic Antisense oligonucleotide
  Description of Combined DNA/RNA Molecule: Synthetic Antisense oligonucleotide
  misc_feature (28)..(29): bicyclic nucleic acid (BNA)
cuccaacaucaaggaagauggcauuucta

SEQ ID NO: 3344 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (27)..(28): bicyclic nucleic acid (BNA)
cuccaacaucaaggaagauggcauuuct

SEQ ID NO: 3345 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (26)..(27): bicyclic nucleic acid (BNA)
cuccaacaucaaggaagauggcauutc

SEQ ID NO: 3346 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (25)..(26): bicyclic nucleic acid (BNA)
cuccaacaucaaggaagauggcautt

SEQ ID NO: 3347 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (24)..(25): bicyclic nucleic acid (BNA)
cuccaacaucaaggaagauggcatt

SEQ ID NO: 3348 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (23)..(24): bicyclic nucleic acid (BNA)
cuccaacaucaaggaagauggcat

SEQ ID NO: 3349 - RNA, 23 nt, Artificial Sequence
  Description of Artificial Sequence: Synthetic Antisense oligonucleotide
  misc_feature (22)..(23): bicyclic nucleic acid (BNA)
cuccaacaucaaggaagauggca

SEQ ID NO: 3350 - RNA, 22 nt, Artificial Sequence
  Description of Artificial Sequence: Synthetic Antisense oligonucleotide
  misc_feature (21)..(22): bicyclic nucleic acid (BNA)
cuccaacaucaaggaagauggc

SEQ ID NO: 3351 - RNA, 21 nt, Artificial Sequence
  Description of Artificial Sequence: Synthetic Antisense oligonucleotide
  misc_feature (20)..(21): bicyclic nucleic acid (BNA)
cuccaacaucaaggaagaugg

SEQ ID NO: 3352 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(20): bicyclic nucleic acid (BNA)
cuccaacaucaaggaagatg

SEQ ID NO: 3353 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(19): bicyclic nucleic acid (BNA)
cuccaacaucaaggaagat

SEQ ID NO: 3354 - RNA, 18 nt, Artificial Sequence
  Description of Artificial Sequence: Synthetic Antisense oligonucleotide
  misc_feature (17)..(18): bicyclic nucleic acid (BNA)
cuccaacaucaaggaaga

SEQ ID NO: 3355 - RNA, 17 nt, Artificial Sequence
  Description of Artificial Sequence: Synthetic Antisense oligonucleotide
  misc_feature (16)..(17): bicyclic nucleic acid (BNA)
cuccaacaucaaggaag

SEQ ID NO: 3356 - RNA, 29 nt, Artificial Sequence
  Description of Artificial Sequence: Synthetic Antisense oligonucleotide
  misc_feature (28)..(29): bicyclic nucleic acid (BNA)
uccaacaucaaggaagauggcauuucuag

SEQ ID NO: 3357 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (27)..(28): bicyclic nucleic acid (BNA)
uccaacaucaaggaagauggcauuucta

SEQ ID NO: 3358 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (26)..(27): bicyclic nucleic acid (BNA)
uccaacaucaaggaagauggcauuuct

SEQ ID NO: 3359 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (25)..(26): bicyclic nucleic acid (BNA)
uccaacaucaaggaagauggcauutc

SEQ ID NO: 3360 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (24)..(25): bicyclic nucleic acid (BNA)
uccaacaucaaggaagauggcautt

SEQ ID NO: 3361 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (23)..(24): bicyclic nucleic acid (BNA)
uccaacaucaaggaagauggcatt

SEQ ID NO: 3362 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (22)..(23): bicyclic nucleic acid (BNA)
uccaacaucaaggaagauggcat

SEQ ID NO: 3363 - RNA, 22 nt, Artificial Sequence
  Description of Artificial Sequence: Synthetic Antisense oligonucleotide
  misc_feature (21)..(22): bicyclic nucleic acid (BNA)
uccaacaucaaggaagauggca

SEQ ID NO: 3364 - RNA, 21 nt, Artificial Sequence
  Description of Artificial Sequence: Synthetic Antisense oligonucleotide
  misc_feature (20)..(21): bicyclic nucleic acid (BNA)
uccaacaucaaggaagauggc

SEQ ID NO: 3365 - RNA, 20 nt, Artificial Sequence
  Description of Artificial Sequence: Synthetic Antisense oligonucleotide
  misc_feature (19)..(20): bicyclic nucleic acid (BNA)
uccaacaucaaggaagaugg

SEQ ID NO: 3366 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(19): bicyclic nucleic acid (BNA)
uccaacaucaaggaagatg

SEQ ID NO: 3367 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(18): bicyclic nucleic acid (BNA)
uccaacaucaaggaagat

SEQ ID NO: 3368 - RNA, 17 nt, Artificial Sequence
  Description of Artificial Sequence: Synthetic Antisense oligonucleotide
  misc_feature (16)..(17): bicyclic nucleic acid (BNA)
uccaacaucaaggaaga

SEQ ID NO: 3369 - RNA, 16 nt, Artificial Sequence
  Description of Artificial Sequence: Synthetic Antisense oligonucleotide
  misc_feature (15)..(16): bicyclic nucleic acid (BNA)
uccaacaucaaggaag

SEQ ID NO: 3370 - RNA, 28 nt, Artificial Sequence
  Description of Artificial Sequence: Synthetic Antisense oligonucleotide
  misc_feature (27)..(28): bicyclic nucleic acid (BNA)
ccaacaucaaggaagauggcauuucuag

SEQ ID NO: 3371 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (26)..(27): bicyclic nucleic acid (BNA)
ccaacaucaaggaagauggcauuucta

SEQ ID NO: 3372 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (25)..(26): bicyclic nucleic acid (BNA)
ccaacaucaaggaagauggcauuuct

SEQ ID NO: 3373 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (24)..(25): bicyclic nucleic acid (BNA)
ccaacaucaaggaagauggcauutc

SEQ ID NO: 3374 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (23)..(24): bicyclic nucleic acid (BNA)
ccaacaucaaggaagauggcautt

SEQ ID NO: 3375 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (22)..(23): bicyclic nucleic acid (BNA)
ccaacaucaaggaagauggcatt

SEQ ID NO: 3376 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (21)..(22): bicyclic nucleic acid (BNA)
ccaacaucaaggaagauggcat

SEQ ID NO: 3377 - RNA, 21 nt, Artificial Sequence
  Description of Artificial Sequence: Synthetic Antisense oligonucleotide
  misc_feature (20)..(21): bicyclic nucleic acid (BNA)
ccaacaucaaggaagauggca

SEQ ID NO: 3378 - RNA, 20 nt, Artificial Sequence
  Description of Artificial Sequence: Synthetic Antisense oligonucleotide
  misc_feature (19)..(20): bicyclic nucleic acid (BNA)
ccaacaucaaggaagauggc

SEQ ID NO: 3379 - RNA, 19 nt, Artificial Sequence
  Description of Artificial Sequence: Synthetic Antisense oligonucleotide
  misc_feature (18)..(19): bicyclic nucleic acid (BNA)
ccaacaucaaggaagaugg

SEQ ID NO: 3380 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(18): bicyclic nucleic acid (BNA)
ccaacaucaaggaagatg

SEQ ID NO: 3381 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(17): bicyclic nucleic acid (BNA)
ccaacaucaaggaagat

SEQ ID NO: 3382 - RNA, 16 nt, Artificial Sequence
  Description of Artificial Sequence: Synthetic Antisense oligonucleotide
  misc_feature (15)..(16): bicyclic nucleic acid (BNA)
ccaacaucaaggaaga

SEQ ID NO: 3383 - RNA, 15 nt, Artificial Sequence
  Description of Artificial Sequence: Synthetic Antisense oligonucleotide
  misc_feature (14)..(15): bicyclic nucleic acid (BNA)
ccaacaucaaggaag

SEQ ID NO: 3384 - RNA, 27 nt, Artificial Sequence
  Description of Artificial Sequence: Synthetic Antisense oligonucleotide
  misc_feature (26)..(27): bicyclic nucleic acid (BNA)
caacaucaaggaagauggcauuucuag

SEQ ID NO: 3385 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (25)..(26): bicyclic nucleic acid (BNA)
caacaucaaggaagauggcauuucta

SEQ ID NO: 3386 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (24)..(25): bicyclic nucleic acid (BNA)
caacaucaaggaagauggcauuuct

SEQ ID NO: 3387 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (23)..(24): bicyclic nucleic acid (BNA)
caacaucaaggaagauggcauutc

SEQ ID NO: 3388 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (22)..(23): bicyclic nucleic acid (BNA)
caacaucaaggaagauggcautt

SEQ ID NO: 3389 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (21)..(22): bicyclic nucleic acid (BNA)
caacaucaaggaagauggcatt

SEQ ID NO: 3390 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (20)..(21): bicyclic nucleic acid (BNA)
caacaucaaggaagauggcat

SEQ ID NO: 3391 - RNA, 20 nt, Artificial Sequence
  Description of Artificial Sequence: Synthetic Antisense oligonucleotide
  misc_feature (19)..(20): bicyclic nucleic acid (BNA)
caacaucaaggaagauggca

SEQ ID NO: 3392 - RNA, 19 nt, Artificial Sequence
  Description of Artificial Sequence: Synthetic Antisense oligonucleotide
  misc_feature (18)..(19): bicyclic nucleic acid (BNA)
caacaucaaggaagauggc

SEQ ID NO: 3393 - RNA, 18 nt, Artificial Sequence
  Description of Artificial Sequence: Synthetic Antisense oligonucleotide
  misc_feature (17)..(18): bicyclic nucleic acid (BNA)
caacaucaaggaagaugg

SEQ ID NO: 3394 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(17): bicyclic nucleic acid (BNA)
caacaucaaggaagatg

SEQ ID NO: 3395 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(16): bicyclic nucleic acid (BNA)
caacaucaaggaagat

SEQ ID NO: 3396 - RNA, 15 nt, Artificial Sequence
  Description of Artificial Sequence: Synthetic Antisense oligonucleotide
  misc_feature (14)..(15): bicyclic nucleic acid (BNA)
caacaucaaggaaga

SEQ ID NO: 3397 - RNA, 14 nt, Artificial Sequence
  Description of Artificial Sequence: Synthetic Antisense oligonucleotide
  misc_feature (13)..(14): bicyclic nucleic acid (BNA)
caacaucaaggaag

SEQ ID NO: 3398 - RNA, 26 nt, Artificial Sequence
  Description of Artificial Sequence: Synthetic Antisense oligonucleotide
  misc_feature (25)..(26): bicyclic nucleic acid (BNA)
aacaucaaggaagauggcauuucuag

SEQ ID NO: 3399 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (24)..(25): bicyclic nucleic acid (BNA)
aacaucaaggaagauggcauuucta

SEQ ID NO: 3400 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (23)..(24): bicyclic nucleic acid (BNA)
aacaucaaggaagauggcauuuct

SEQ ID NO: 3401 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (22)..(23): bicyclic nucleic acid (BNA)
aacaucaaggaagauggcauutc

SEQ ID NO: 3402 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (21)..(22): bicyclic nucleic acid (BNA)
aacaucaaggaagauggcautt

SEQ ID NO: 3403 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (20)..(21): bicyclic nucleic acid (BNA)
aacaucaaggaagauggcatt

SEQ ID NO: 3404 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(20): bicyclic nucleic acid (BNA)
aacaucaaggaagauggcat

SEQ ID NO: 3405 - RNA, 19 nt, Artificial Sequence
  Description of Artificial Sequence: Synthetic Antisense oligonucleotide
  misc_feature (18)..(19): bicyclic nucleic acid (BNA)
aacaucaaggaagauggca

SEQ ID NO: 3406 - RNA, 18 nt, Artificial Sequence
  Description of Artificial Sequence: Synthetic Antisense oligonucleotide
  misc_feature (17)..(18): bicyclic nucleic acid (BNA)
aacaucaaggaagauggc

SEQ ID NO: 3407 - RNA, 17 nt, Artificial Sequence
  Description of Artificial Sequence: Synthetic Antisense oligonucleotide
  misc_feature (16)..(17): bicyclic nucleic acid (BNA)
aacaucaaggaagaugg

SEQ ID NO: 3408 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (15)..(16): bicyclic nucleic acid (BNA)
aacaucaaggaagatg

SEQ ID NO: 3409 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(15): bicyclic nucleic acid (BNA)
aacaucaaggaagat

SEQ ID NO: 3410 - RNA, 14 nt, Artificial Sequence
  Description of Artificial Sequence: Synthetic Antisense oligonucleotide
  misc_feature (13)..(14): bicyclic nucleic acid (BNA)
aacaucaaggaaga

SEQ ID NO: 3411 - RNA, 13 nt, Artificial Sequence
  Description of Artificial Sequence: Synthetic Antisense oligonucleotide
  misc_feature (12)..(13): bicyclic nucleic acid (BNA)
aacaucaaggaag

SEQ ID NO: 3412 - RNA, 25 nt, Artificial Sequence
  Description of Artificial Sequence: Synthetic Antisense oligonucleotide
  misc_feature (24)..(25): bicyclic nucleic acid (BNA)
acaucaaggaagauggcauuucuag

SEQ ID NO: 3413 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (23)..(24): bicyclic nucleic acid (BNA)
acaucaaggaagauggcauuucta

SEQ ID NO: 3414 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (22)..(23): bicyclic nucleic acid (BNA)
acaucaaggaagauggcauuuct

SEQ ID NO: 3415 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (21)..(22): bicyclic nucleic acid (BNA)
acaucaaggaagauggcauutc

SEQ ID NO: 3416 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (20)..(21): bicyclic nucleic acid (BNA)
acaucaaggaagauggcautt

SEQ ID NO: 3417 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(20): bicyclic nucleic acid (BNA)
acaucaaggaagauggcatt

SEQ ID NO: 3418 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(19): bicyclic nucleic acid (BNA)
acaucaaggaagauggcat

SEQ ID NO: 3419 - RNA, 18 nt, Artificial Sequence
  Description of Artificial Sequence: Synthetic Antisense oligonucleotide
  misc_feature (17)..(18): bicyclic nucleic acid (BNA)
acaucaaggaagauggca

SEQ ID NO: 3420 - RNA, 17 nt, Artificial Sequence
  Description of Artificial Sequence: Synthetic Antisense oligonucleotide
  misc_feature (16)..(17): bicyclic nucleic acid (BNA)
acaucaaggaagauggc

SEQ ID NO: 3421 - RNA, 16 nt, Artificial Sequence
  Description of Artificial Sequence: Synthetic Antisense oligonucleotide
  misc_feature (15)..(16): bicyclic nucleic acid (BNA)
acaucaaggaagaugg

SEQ ID NO: 3422 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(15): bicyclic nucleic acid (BNA)
acaucaaggaagatg

SEQ ID NO: 3423 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(14): bicyclic nucleic acid (BNA)
acaucaaggaagat

SEQ ID NO: 3424 - RNA, 13 nt, Artificial Sequence
  Description of Artificial Sequence: Synthetic Antisense oligonucleotide
  misc_feature (12)..(13): bicyclic nucleic acid (BNA)
acaucaaggaaga

SEQ ID NO: 3425 - RNA, 12 nt, Artificial Sequence
  Description of Artificial Sequence: Synthetic Antisense oligonucleotide
  misc_feature (11)..(12): bicyclic nucleic acid (BNA)
acaucaaggaag

SEQ ID NO: 3426 - RNA, 24 nt, Artificial Sequence
  Description of Artificial Sequence: Synthetic Antisense oligonucleotide
  misc_feature (23)..(24): bicyclic nucleic acid (BNA)
caucaaggaagauggcauuucuag

SEQ ID NO: 3427 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (22)..(23): bicyclic nucleic acid (BNA)
caucaaggaagauggcauuucta

SEQ ID NO: 3428 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (21)..(22): bicyclic nucleic acid (BNA)
caucaaggaagauggcauuuct

SEQ ID NO: 3429 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (20)..(21): bicyclic nucleic acid (BNA)
caucaaggaagauggcauutc

SEQ ID NO: 3430 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(20): bicyclic nucleic acid (BNA)
caucaaggaagauggcautt

SEQ ID NO: 3431 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(19): bicyclic nucleic acid (BNA)
caucaaggaagauggcatt

SEQ ID NO: 3432 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(18): bicyclic nucleic acid (BNA)
caucaaggaagauggcat

SEQ ID NO: 3433 - RNA, 17 nt, Artificial Sequence
  Description of Artificial Sequence: Synthetic Antisense oligonucleotide
  misc_feature (16)..(17): bicyclic nucleic acid (BNA)
caucaaggaagauggca

SEQ ID NO: 3434 - RNA, 16 nt, Artificial Sequence
  Description of Artificial Sequence: Synthetic Antisense oligonucleotide
  misc_feature (15)..(16): bicyclic nucleic acid (BNA)
caucaaggaagauggc

SEQ ID NO: 3435 - RNA, 15 nt, Artificial Sequence
  Description of Artificial Sequence: Synthetic Antisense oligonucleotide
  misc_feature (14)..(15): bicyclic nucleic acid (BNA)
caucaaggaagaugg

SEQ ID NO: 3436 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(14): bicyclic nucleic acid (BNA)
caucaaggaagatg

SEQ ID NO: 3437 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(13): bicyclic nucleic acid (BNA)
caucaaggaagat

SEQ ID NO: 3438 - RNA, 12 nt, Artificial Sequence
  Description of Artificial Sequence: Synthetic Antisense oligonucleotide
  misc_feature (11)..(12): bicyclic nucleic acid (BNA)
caucaaggaaga

SEQ ID NO: 3439 - RNA, 11 nt, Artificial Sequence
  Description of Artificial Sequence: Synthetic Antisense oligonucleotide
  misc_feature (10)..(11): bicyclic nucleic acid (BNA)
caucaaggaag

SEQ ID NO: 3440 - RNA, 23 nt, Artificial Sequence
  Description of Artificial Sequence: Synthetic Antisense oligonucleotide
  misc_feature (22)..(23): bicyclic nucleic acid (BNA)
aucaaggaagauggcauuucuag

SEQ ID NO: 3441 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (21)..(22): bicyclic nucleic acid (BNA)
aucaaggaagauggcauuucta

SEQ ID NO: 3442 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (20)..(21): bicyclic nucleic acid (BNA)
aucaaggaagauggcauuuct

SEQ ID NO: 3443 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (19)..(20): bicyclic nucleic acid (BNA)
aucaaggaagauggcauutc

SEQ ID NO: 3444 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (18)..(19): bicyclic nucleic acid (BNA)
aucaaggaagauggcautt

SEQ ID NO: 3445 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (17)..(18): bicyclic nucleic acid (BNA)
aucaaggaagauggcatt

SEQ ID NO: 3446 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (16)..(17): bicyclic nucleic acid (BNA)
aucaaggaagauggcat

SEQ ID NO: 3447 - RNA, 16 nt, Artificial Sequence
  Description of Artificial Sequence: Synthetic Antisense oligonucleotide
  misc_feature (15)..(16): bicyclic nucleic acid (BNA)
aucaaggaagauggca

SEQ ID NO: 3448 - RNA, 15 nt, Artificial Sequence
  Description of Artificial Sequence: Synthetic Antisense oligonucleotide
  misc_feature (14)..(15): bicyclic nucleic acid (BNA)
aucaaggaagauggc

SEQ ID NO: 3449 - RNA, 14 nt, Artificial Sequence
  Description of Artificial Sequence: Synthetic Antisense oligonucleotide
  misc_feature (13)..(14): bicyclic nucleic acid (BNA)
aucaaggaagaugg

SEQ ID NO: 3450 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(13): bicyclic nucleic acid (BNA)
aucaaggaagatg

SEQ ID NO: 3451 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(12): bicyclic nucleic acid (BNA)
aucaaggaagat

SEQ ID NO: 3452 - RNA, 11 nt, Artificial Sequence
  Description of Artificial Sequence: Synthetic Antisense oligonucleotide
  misc_feature (10)..(11): bicyclic nucleic acid (BNA)
aucaaggaaga

SEQ ID NO: 3453 - RNA, 10 nt, Artificial Sequence
  Description of Artificial Sequence: Synthetic Antisense oligonucleotide
  misc_feature (9)..(10): bicyclic nucleic acid (BNA)
aucaaggaag

SEQ ID NO: 3454 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
gguaaguucuguccaagc

SEQ ID NO: 3455 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
gtaaguucuguccaagcc

SEQ ID NO: 3456 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
agucgguaaguucugucc

SEQ ID NO: 3457 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
ctguccaagcccgguuga

SEQ ID NO: 3458 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
taaguucuguccaag

SEQ ID NO: 3459 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
ttcuguccaagcccgguuga

SEQ ID NO: 3460 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
ttcuguccaagcccggutg

SEQ ID NO: 3461 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
ttcuguccaagcccggtt

SEQ ID NO: 3462 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
ttcuguccaagcccggt

SEQ ID NO: 3463 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
ttcuguccaagcccgg

SEQ ID NO: 3464 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
ttcuguccaagcccg

SEQ ID NO: 3465 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
ttcuguccaagccc

SEQ ID NO: 3466 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
ttcuguccaagcc

SEQ ID NO: 3467 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
ttcuguccaagc

SEQ ID NO: 3468 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
ttcuguccaag

SEQ ID NO: 3469 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
ttcuguccaa

SEQ ID NO: 3470 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
ttcugucca

SEQ ID NO: 3471 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(8): bicyclic nucleic acid (BNA)
ttcugucc

SEQ ID NO: 3472 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
tcuguccaagcccgguuga

SEQ ID NO: 3473 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
tcuguccaagcccggutg

SEQ ID NO: 3474 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
tcuguccaagcccggtt

SEQ ID NO: 3475 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
tcuguccaagcccggt

SEQ ID NO: 3476 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
tcuguccaagcccgg

SEQ ID NO: 3477 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
tcuguccaagcccg

SEQ ID NO: 3478 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
tcuguccaagccc

SEQ ID NO: 3479 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
tcuguccaagcc

SEQ ID NO: 3480 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
tcuguccaagc

SEQ ID NO: 3481 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
tcuguccaag

SEQ ID NO: 3482 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
tcuguccaa

SEQ ID NO: 3483 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(8): bicyclic nucleic acid (BNA)
tcugucca

SEQ ID NO: 3484 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
ctguccaagcccggutg

SEQ ID NO: 3485 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
ctguccaagcccggtt

SEQ ID NO: 3486 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
ctguccaagcccggt

SEQ ID NO: 3487 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
ctguccaagcccgg

SEQ ID NO: 3488 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
ctguccaagcccg

SEQ ID NO: 3489 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
ctguccaagccc

SEQ ID NO: 3490 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
ctguccaagcc

SEQ ID NO: 3491 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
ctguccaagc

SEQ ID NO: 3492 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
ctguccaag

SEQ ID NO: 3493 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(8): bicyclic nucleic acid (BNA)
ctguccaa

SEQ ID NO: 3494 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
gtucuguccaagcccggutg

SEQ ID NO: 3495 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
gtucuguccaagcccggtt

SEQ ID NO: 3496 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
gtucuguccaagcccggt

SEQ ID NO: 3497 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
gtucuguccaagcccgg

SEQ ID NO: 3498 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
gtucuguccaagcccg

SEQ ID NO: 3499 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
gtucuguccaagccc

SEQ ID NO: 3500 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
gtucuguccaagcc

SEQ ID NO: 3501 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
gtucuguccaagc

SEQ ID NO: 3502 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
gtucuguccaag

SEQ ID NO: 3503 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
gtucuguccaa

SEQ ID NO: 3504 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
gtucugucca

SEQ ID NO: 3505 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
gtucugucc

SEQ ID NO: 3506 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(8): bicyclic nucleic acid (BNA)
gtucugtc

SEQ ID NO: 3507 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
aguucuguccaagcccggtt

SEQ ID NO: 3508 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
aguucuguccaagcccggt

SEQ ID NO: 3509 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
aguucuguccaagcccgg

SEQ ID NO: 3510 - RNA, 17 nt, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
aguucuguccaagcccg

SEQ ID NO: 3511 - RNA, 16 nt, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
aguucuguccaagccc

SEQ ID NO: 3512 - RNA, 15 nt, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
aguucuguccaagcc

SEQ ID NO: 3513 - RNA, 14 nt, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
aguucuguccaagc

SEQ ID NO: 3514 - RNA, 13 nt, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
aguucuguccaag

SEQ ID NO: 3515 - RNA, 12 nt, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
aguucuguccaa

SEQ ID NO: 3516 - RNA, 11 nt, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
aguucugucca

SEQ ID NO: 3517 - RNA, 10 nt, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
aguucugucc

SEQ ID NO: 3518 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
aguucugtc

SEQ ID NO: 3519 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(8): bicyclic nucleic acid (BNA)
aguucugt

SEQ ID NO: 3520 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
aaguucuguccaagcccggt

SEQ ID NO: 3521 - RNA, 19 nt, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
aaguucuguccaagcccgg

SEQ ID NO: 3522 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
aaguucuguccaagcccg

SEQ ID NO: 3523 - RNA, 17 nt, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
aaguucuguccaagccc

SEQ ID NO: 3524 - RNA, 16 nt, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
aaguucuguccaagcc

SEQ ID NO: 3525 - RNA, 15 nt, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
aaguucuguccaagc

SEQ ID NO: 3526 - RNA, 14 nt, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
aaguucuguccaag

SEQ ID NO: 3527 - RNA, 13 nt, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
aaguucuguccaa

SEQ ID NO: 3528 - RNA, 12 nt, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
aaguucugucca

SEQ ID NO: 3529 - RNA, 11 nt, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
aaguucugucc

SEQ ID NO: 3530 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
aaguucugtc

SEQ ID NO: 3531 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
aaguucugt

SEQ ID NO: 3532 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(8): bicyclic nucleic acid (BNA)
aaguuctg

SEQ ID NO: 3533 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
taaguucuguccaagcccgg

SEQ ID NO: 3534 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
taaguucuguccaagcccg

SEQ ID NO: 3535 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
taaguucuguccaagccc

SEQ ID NO: 3536 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
taaguucuguccaagcc

SEQ ID NO: 3537 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
taaguucuguccaagc

SEQ ID NO: 3538 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
taaguucuguccaa

SEQ ID NO: 3539 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
taaguucugucca

SEQ ID NO: 3540 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
taaguucugucc

SEQ ID NO: 3541 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
taaguucugtc

SEQ ID NO: 3542 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
taaguucugt

SEQ ID NO: 3543 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
taaguuctg

SEQ ID NO: 3544 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(8): bicyclic nucleic acid (BNA)
taaguuct

SEQ ID NO: 3545 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
gtaaguucuguccaagcccg

SEQ ID NO: 3546 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
gtaaguucuguccaagccc

SEQ ID NO: 3547 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
gtaaguucuguccaagc

SEQ ID NO: 3548 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
gtaaguucuguccaag

SEQ ID NO: 3549 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
gtaaguucuguccaa

SEQ ID NO: 3550 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
gtaaguucugucca

SEQ ID NO: 3551 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
gtaaguucugucc

SEQ ID NO: 3552 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
gtaaguucugtc

SEQ ID NO: 3553 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
gtaaguucugt

SEQ ID NO: 3554 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
gtaaguuctg

SEQ ID NO: 3555 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
gtaaguuct

SEQ ID NO: 3556 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(8): bicyclic nucleic acid (BNA)
gtaagutc

SEQ ID NO: 3557 - RNA, 20 nt, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
gguaaguucuguccaagccc

SEQ ID NO: 3558 - RNA, 19 nt, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
gguaaguucuguccaagcc

SEQ ID NO: 3559 - RNA, 17 nt, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
gguaaguucuguccaag

SEQ ID NO: 3560 - RNA, 16 nt, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
gguaaguucuguccaa

SEQ ID NO: 3561 - RNA, 15 nt, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
gguaaguucugucca

SEQ ID NO: 3562 - RNA, 14 nt, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
gguaaguucugucc

SEQ ID NO: 3563 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
gguaaguucugtc

SEQ ID NO: 3564 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
gguaaguucugt

SEQ ID NO: 3565 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
gguaaguuctg

SEQ ID NO: 3566 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
gguaaguuct

SEQ ID NO: 3567 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
gguaagutc

SEQ ID NO: 3568 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(8): bicyclic nucleic acid (BNA)
gguaagtt

SEQ ID NO: 3569 - RNA, 20 nt, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
cgguaaguucuguccaagcc

SEQ ID NO: 3570 - RNA, 19 nt, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
cgguaaguucuguccaagc

SEQ ID NO: 3571 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
cgguaaguucuguccaag

SEQ ID NO: 3572 - RNA, 17 nt, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
cgguaaguucuguccaa

SEQ ID NO: 3573 - RNA, 16 nt, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
cgguaaguucugucca

SEQ ID NO: 3574 - RNA, 15 nt, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
cgguaaguucugucc

SEQ ID NO: 3575 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
cgguaaguucugtc

SEQ ID NO: 3576 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
cgguaaguucugt

SEQ ID NO: 3577 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
cgguaaguuctg

SEQ ID NO: 3578 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
cgguaaguuct

SEQ ID NO: 3579 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
cgguaagutc

SEQ ID NO: 3580 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
cgguaagtt

SEQ ID NO: 3581 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(8): bicyclic nucleic acid (BNA)
cgguaagt

SEQ ID NO: 3582 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
tcgguaaguucuguccaagc

SEQ ID NO: 3583 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
tcgguaaguucuguccaag

SEQ ID NO: 3584 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
tcgguaaguucuguccaa

SEQ ID NO: 3585 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
tcgguaaguucugucca

SEQ ID NO: 3586 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
tcgguaaguucugucc

SEQ ID NO: 3587 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
tcgguaaguucugtc

SEQ ID NO: 3588 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
tcgguaaguucugt

SEQ ID NO: 3589 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
tcgguaaguuctg

SEQ ID NO: 3590 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
tcgguaaguuct

SEQ ID NO: 3591 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
tcgguaagutc

SEQ ID NO: 3592 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
tcgguaagtt

SEQ ID NO: 3593 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
tcgguaagt

SEQ ID NO: 3594 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
gtcgguaaguucuguccaag

SEQ ID NO: 3595 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
gtcgguaaguucuguccaa

SEQ ID NO: 3596 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
gtcgguaaguucugucca

SEQ ID NO: 3597 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
gtcgguaaguucugucc

SEQ ID NO: 3598 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
gtcgguaaguucugtc

SEQ ID NO: 3599 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
gtcgguaaguucugt

SEQ ID NO: 3600 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
gtcgguaaguuctg

SEQ ID NO: 3601 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
gtcgguaaguuct

SEQ ID NO: 3602 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
gtcgguaagutc

SEQ ID NO: 3603 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
gtcgguaagtt

SEQ ID NO: 3604 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
gtcgguaagt

SEQ ID NO: 3605 - RNA, 20 nt, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
agucgguaaguucuguccaa

SEQ ID NO: 3606 - RNA, 19 nt, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
agucgguaaguucugucca

SEQ ID NO: 3607 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
agucgguaaguucugtc

SEQ ID NO: 3608 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
agucgguaaguucugt

SEQ ID NO: 3609 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
agucgguaaguuctg

SEQ ID NO: 3610 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
agucgguaaguuct

SEQ ID NO: 3611 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
agucgguaagutc

SEQ ID NO: 3612 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
agucgguaagtt

SEQ ID NO: 3613 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
agucgguaagt

SEQ ID NO: 3614 - RNA, 20 nt, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
cagucgguaaguucugucca

SEQ ID NO: 3615 - RNA, 19 nt, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
cagucgguaaguucugucc

SEQ ID NO: 3616 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
cagucgguaaguucugtc

SEQ ID NO: 3617 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
cagucgguaaguucugt

SEQ ID NO: 3618 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
cagucgguaaguuctg

SEQ ID NO: 3619 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
cagucgguaaguuct

SEQ ID NO: 3620 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
cagucgguaagutc

SEQ ID NO: 3621 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
cagucgguaagtt

SEQ ID NO: 3622 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
cagucgguaagt

SEQ ID NO: 3623 - RNA, 20 nt, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
ccagucgguaaguucugucc

SEQ ID NO: 3624 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
ccagucgguaaguucugtc

SEQ ID NO: 3625 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
ccagucgguaaguucugt

SEQ ID NO: 3626 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
ccagucgguaaguuctg

SEQ ID NO: 3627 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
ccagucgguaaguuct

SEQ ID NO: 3628 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
ccagucgguaagutc

SEQ ID NO: 3629 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
ccagucgguaagtt

SEQ ID NO: 3630 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
ccagucgguaagt

SEQ ID NO: 3631 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
gccagucgguaaguucugtc

SEQ ID NO: 3632 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
gccagucgguaaguucugt

SEQ ID NO: 3633 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
gccagucgguaaguuctg

SEQ ID NO: 3634 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
gccagucgguaaguuct

SEQ ID NO: 3635 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
gccagucgguaagutc

SEQ ID NO: 3636 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
gccagucgguaagtt

SEQ ID NO: 3637 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
gccagucgguaagt

SEQ ID NO: 3638 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
tcaaggaagauggcauuuct

SEQ ID NO: 3639 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (21)..(22): bicyclic nucleic acid (BNA)
tcaaggaagauggcauuucuag

SEQ ID NO: 3640 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
tcaaggaagauggcat

SEQ ID NO: 3641 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
gaagauggcauuuct

SEQ ID NO: 3642 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (20)..(21): bicyclic nucleic acid (BNA)
tcaaggaagauggcauuucta

SEQ ID NO: 3643 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
tcaaggaagauggcauutc

SEQ ID NO: 3644 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
tcaaggaagauggcautt

SEQ ID NO: 3645 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
tcaaggaagauggcatt

SEQ ID NO: 3646 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
tcaaggaagauggca

SEQ ID NO: 3647 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
tcaaggaagauggc

SEQ ID NO: 3648 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
tcaaggaagaugg

SEQ ID NO: 3649 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
tcaaggaagatg

SEQ ID NO: 3650 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
tcaaggaagat

SEQ ID NO: 3651 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
tcaaggaaga

SEQ ID NO: 3652 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
tcaaggaag

SEQ ID NO: 3653 - RNA, 21 nt, Artificial Sequence
  Description of Artificial Sequence: Synthetic Antisense oligonucleotide
  misc_feature (1)..(2): bicyclic nucleic acid (BNA)
  misc_feature (20)..(21): bicyclic nucleic acid (BNA)
caaggaagauggcauuucuag

SEQ ID NO: 3654 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
caaggaagauggcauuucta

SEQ ID NO: 3655 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
caaggaagauggcauuuct

SEQ ID NO: 3656 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
caaggaagauggcauutc

SEQ ID NO: 3657 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
caaggaagauggcautt

SEQ ID NO: 3658 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
caaggaagauggcatt

SEQ ID NO: 3659 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
caaggaagauggcat

SEQ ID NO: 3660 - RNA, 14 nt, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
caaggaagauggca

SEQ ID NO: 3661 - RNA, 13 nt, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
caaggaagauggc

SEQ ID NO: 3662 - RNA, 12 nt, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
caaggaagaugg

SEQ ID NO: 3663 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
caaggaagatg

SEQ ID NO: 3664 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
caaggaagat

SEQ ID NO: 3665 - RNA, 9 nt, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
caaggaaga

SEQ ID NO: 3666 - RNA, 8 nt, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
caaggaag

SEQ ID NO: 3667 - RNA, 20 nt, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
aaggaagauggcauuucuag

SEQ ID NO: 3668 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
aaggaagauggcauuucta

SEQ ID NO: 3669 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
aaggaagauggcauuuct

SEQ ID NO: 3670 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
aaggaagauggcauutc

SEQ ID NO: 3671 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
aaggaagauggcautt

SEQ ID NO: 3672 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
aaggaagauggcatt

SEQ ID NO: 3673 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
aaggaagauggcat

SEQ ID NO: 3674 - RNA, 13 nt, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
aaggaagauggca

SEQ ID NO: 3675 - RNA, 12 nt, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
aaggaagauggc

SEQ ID NO: 3676 - RNA, 11 nt, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
aaggaagaugg

SEQ ID NO: 3677 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
aaggaagatg

SEQ ID NO: 3678 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
aaggaagat

SEQ ID NO: 3679 - RNA, 8 nt, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
aaggaaga

SEQ ID NO: 3680 - RNA, 19 nt, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
aggaagauggcauuucuag

SEQ ID NO: 3681 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
aggaagauggcauuucta

SEQ ID NO: 3682 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
aggaagauggcauuuct

SEQ ID NO: 3683 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
aggaagauggcauutc

SEQ ID NO: 3684 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
aggaagauggcautt

SEQ ID NO: 3685 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
aggaagauggcatt

SEQ ID NO: 3686 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
aggaagauggcat

SEQ ID NO: 3687 - RNA, 12 nt, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
aggaagauggca

SEQ ID NO: 3688 - RNA, 10 nt, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
aggaagaugg

SEQ ID NO: 3689 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
aggaagatg

SEQ ID NO: 3690 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
aggaagat

SEQ ID NO: 3691 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
ggaagauggcauuucuag

SEQ ID NO: 3692 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
ggaagauggcauuucta

SEQ ID NO: 3693 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
ggaagauggcauuuct

SEQ ID NO: 3694 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
ggaagauggcauutc

SEQ ID NO: 3695 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
ggaagauggcautt

SEQ ID NO: 3696 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
ggaagauggcatt

SEQ ID NO: 3697 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
ggaagauggcat

SEQ ID NO: 3698 - RNA, 11 nt, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
ggaagauggca

SEQ ID NO: 3699 - RNA, 10 nt, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
ggaagauggc

SEQ ID NO: 3700 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
ggaagatg

SEQ ID NO: 3701 - RNA, 17 nt, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
gaagauggcauuucuag

SEQ ID NO: 3702 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
gaagauggcauuucta

SEQ ID NO: 3703 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
gaagauggcauutc

SEQ ID NO: 3704 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
gaagauggcautt

SEQ ID NO: 3705 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
gaagauggcatt

SEQ ID NO: 3706 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
gaagauggcat

SEQ ID NO: 3707 - RNA, 10 nt, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
gaagauggca

SEQ ID NO: 3708 - RNA, 9 nt, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
gaagauggc

SEQ ID NO: 3709 - RNA, 8 nt, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
gaagaugg

SEQ ID NO: 3710 - RNA, 16 nt, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
aagauggcauuucuag

SEQ ID NO: 3711 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
aagauggcauuucta

SEQ ID NO: 3712 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
aagauggcauuuct

SEQ ID NO: 3713 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
aagauggcauutc

SEQ ID NO: 3714 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
aagauggcautt

SEQ ID NO: 3715 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
aagauggcatt

SEQ ID NO: 3716 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
aagauggcat

SEQ ID NO: 3717 - RNA, 9 nt, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
aagauggca

SEQ ID NO: 3718 - RNA, 8 nt, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
aagauggc

SEQ ID NO: 3719 - RNA, 15 nt, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
agauggcauuucuag

SEQ ID NO: 3720 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
agauggcauuucta

SEQ ID NO: 3721 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
agauggcauuuct

SEQ ID NO: 3722 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
agauggcauutc

SEQ ID NO: 3723 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
agauggcautt

SEQ ID NO: 3724 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
agauggcatt

SEQ ID NO: 3725 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
agauggcat

SEQ ID NO: 3726 - RNA, 8 nt, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
agauggca

SEQ ID NO: 3727 - DNA, 30 bp, Artificial Sequence; identical to SEQ ID NO: 2957
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (29)..(30): bicyclic nucleic acid (BNA)

SEQ ID NO: 3728 - DNA, 29 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (28)..(29): bicyclic nucleic acid (BNA)
ctccaacaucaaggaagauggcauuucta

SEQ ID NO: 3729 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (27)..(28): bicyclic nucleic acid (BNA)
ctccaacaucaaggaagauggcauuuct

SEQ ID NO: 3730 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (26)..(27): bicyclic nucleic acid (BNA)
ctccaacaucaaggaagauggcauutc

SEQ ID NO: 3731 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (25)..(26): bicyclic nucleic acid (BNA)
ctccaacaucaaggaagauggcautt

SEQ ID NO: 3732 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (24)..(25): bicyclic nucleic acid (BNA)
ctccaacaucaaggaagauggcatt

SEQ ID NO: 3733 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (23)..(24): bicyclic nucleic acid (BNA)
ctccaacaucaaggaagauggcat

SEQ ID NO: 3734 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (22)..(23): bicyclic nucleic acid (BNA)
ctccaacaucaaggaagauggca

SEQ ID NO: 3735 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (21)..(22): bicyclic nucleic acid (BNA)
ctccaacaucaaggaagauggc

SEQ ID NO: 3736 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (20)..(21): bicyclic nucleic acid (BNA)
ctccaacaucaaggaagaugg

SEQ ID NO: 3737 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
ctccaacaucaaggaagatg

SEQ ID NO: 3738 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
ctccaacaucaaggaagat

SEQ ID NO: 3739 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
ctccaacaucaaggaaga

SEQ ID NO: 3740 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
ctccaacaucaaggaag

SEQ ID NO: 3741 - DNA, 29 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (28)..(29): bicyclic nucleic acid (BNA)
tccaacaucaaggaagauggcauuucuag

SEQ ID NO: 3742 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (27)..(28): bicyclic nucleic acid (BNA)
tccaacaucaaggaagauggcauuucta

SEQ ID NO: 3743 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (26)..(27): bicyclic nucleic acid (BNA)
tccaacaucaaggaagauggcauuuct

SEQ ID NO: 3744 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (25)..(26): bicyclic nucleic acid (BNA)
tccaacaucaaggaagauggcauutc

SEQ ID NO: 3745 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (24)..(25): bicyclic nucleic acid (BNA)
tccaacaucaaggaagauggcautt

SEQ ID NO: 3746 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (23)..(24): bicyclic nucleic acid (BNA)
tccaacaucaaggaagauggcatt

SEQ ID NO: 3747 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (22)..(23): bicyclic nucleic acid (BNA)
tccaacaucaaggaagauggcat

SEQ ID NO: 3748 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (21)..(22): bicyclic nucleic acid (BNA)
tccaacaucaaggaagauggca

SEQ ID NO: 3749 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (20)..(21): bicyclic nucleic acid (BNA)
tccaacaucaaggaagauggc

SEQ ID NO: 3750 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
tccaacaucaaggaagaugg

SEQ ID NO: 3751 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
tccaacaucaaggaagatg

SEQ ID NO: 3752 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
tccaacaucaaggaagat

SEQ ID NO: 3753 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
tccaacaucaaggaaga

SEQ ID NO: 3754 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
tccaacaucaaggaag

SEQ ID NO: 3755 - RNA, 28 nt, Artificial Sequence
  Description of Artificial Sequence: Synthetic Antisense oligonucleotide
  misc_feature (1)..(2): bicyclic nucleic acid (BNA)
  misc_feature (27)..(28): bicyclic nucleic acid (BNA)
ccaacaucaaggaagauggcauuucuag

SEQ ID NO: 3756 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (26)..(27): bicyclic nucleic acid (BNA)
ccaacaucaaggaagauggcauuucta

SEQ ID NO: 3757 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (25)..(26): bicyclic nucleic acid (BNA)
ccaacaucaaggaagauggcauuuct

SEQ ID NO: 3758 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (24)..(25): bicyclic nucleic acid (BNA)
ccaacaucaaggaagauggcauutc

SEQ ID NO: 3759 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (23)..(24): bicyclic nucleic acid (BNA)
ccaacaucaaggaagauggcautt

SEQ ID NO: 3760 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (22)..(23): bicyclic nucleic acid (BNA)
ccaacaucaaggaagauggcatt

SEQ ID NO: 3761 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (21)..(22): bicyclic nucleic acid (BNA)
ccaacaucaaggaagauggcat

SEQ ID NO: 3762 - RNA, 21 nt, Artificial Sequence
  Description of Artificial Sequence: Synthetic Antisense oligonucleotide
  misc_feature (1)..(2): bicyclic nucleic acid (BNA)
  misc_feature (20)..(21): bicyclic nucleic acid (BNA)
ccaacaucaaggaagauggca

SEQ ID NO: 3763 - RNA, 20 nt, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
ccaacaucaaggaagauggc

SEQ ID NO: 3764 - RNA, 19 nt, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
ccaacaucaaggaagaugg

SEQ ID NO: 3765 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
ccaacaucaaggaagatg

SEQ ID NO: 3766 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
ccaacaucaaggaagat

SEQ ID NO: 3767 - RNA, 16 nt, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
ccaacaucaaggaaga

SEQ ID NO: 3768 - RNA, 15 nt, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
ccaacaucaaggaag

SEQ ID NO: 3769 - RNA, 27 nt, Artificial Sequence
  Description of Artificial Sequence: Synthetic Antisense oligonucleotide
  misc_feature (1)..(2): bicyclic nucleic acid (BNA)
  misc_feature (26)..(27): bicyclic nucleic acid (BNA)
caacaucaaggaagauggcauuucuag

SEQ ID NO: 3770 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (25)..(26): bicyclic nucleic acid (BNA)
caacaucaaggaagauggcauuucta

SEQ ID NO: 3771 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (24)..(25): bicyclic nucleic acid (BNA)
caacaucaaggaagauggcauuuct

SEQ ID NO: 3772 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (23)..(24): bicyclic nucleic acid (BNA)
caacaucaaggaagauggcauutc

SEQ ID NO: 3773 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (22)..(23): bicyclic nucleic acid (BNA)
caacaucaaggaagauggcautt

SEQ ID NO: 3774 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (21)..(22): bicyclic nucleic acid (BNA)
caacaucaaggaagauggcatt

SEQ ID NO: 3775 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (20)..(21): bicyclic nucleic acid (BNA)
caacaucaaggaagauggcat

SEQ ID NO: 3776 - RNA, 20 nt, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
caacaucaaggaagauggca

SEQ ID NO: 3777 - RNA, 19 nt, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
caacaucaaggaagauggc

SEQ ID NO: 3778 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
caacaucaaggaagaugg

SEQ ID NO: 3779 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
caacaucaaggaagatg

SEQ ID NO: 3780 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
caacaucaaggaagat

SEQ ID NO: 3781 - RNA, 15 nt, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
caacaucaaggaaga

SEQ ID NO: 3782 - RNA, 14 nt, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
caacaucaaggaag

SEQ ID NO: 3783 - RNA, 26 nt, Artificial Sequence
  Description of Artificial Sequence: Synthetic Antisense oligonucleotide
  misc_feature (1)..(2): bicyclic nucleic acid (BNA)
  misc_feature (25)..(26): bicyclic nucleic acid (BNA)
aacaucaaggaagauggcauuucuag

SEQ ID NO: 3784 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (24)..(25): bicyclic nucleic acid (BNA)
aacaucaaggaagauggcauuucta

SEQ ID NO: 3785 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (23)..(24): bicyclic nucleic acid (BNA)
aacaucaaggaagauggcauuuct

SEQ ID NO: 3786 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (22)..(23): bicyclic nucleic acid (BNA)
aacaucaaggaagauggcauutc

SEQ ID NO: 3787 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (21)..(22): bicyclic nucleic acid (BNA)
aacaucaaggaagauggcautt

SEQ ID NO: 3788 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (20)..(21): bicyclic nucleic acid (BNA)
aacaucaaggaagauggcatt

SEQ ID NO: 3789 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
aacaucaaggaagauggcat

SEQ ID NO: 3790 - RNA, 19 nt, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
aacaucaaggaagauggca

SEQ ID NO: 3791 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
aacaucaaggaagauggc

SEQ ID NO: 3792 - RNA, 17 nt, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
aacaucaaggaagaugg

SEQ ID NO: 3793 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
aacaucaaggaagatg

SEQ ID NO: 3794 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
aacaucaaggaagat

SEQ ID NO: 3795 - RNA, 14 nt, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
aacaucaaggaaga

SEQ ID NO: 3796 - RNA, 13 nt, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
aacaucaaggaag

SEQ ID NO: 3797 - RNA, 25 nt, Artificial Sequence
  Description of Artificial Sequence: Synthetic Antisense oligonucleotide
  misc_feature (1)..(2): bicyclic nucleic acid (BNA)
  misc_feature (24)..(25): bicyclic nucleic acid (BNA)
acaucaaggaagauggcauuucuag

SEQ ID NO: 3798 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (23)..(24): bicyclic nucleic acid (BNA)
acaucaaggaagauggcauuucta

SEQ ID NO: 3799 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (22)..(23): bicyclic nucleic acid (BNA)
acaucaaggaagauggcauuuct

SEQ ID NO: 3800 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (21)..(22): bicyclic nucleic acid (BNA)
acaucaaggaagauggcauutc

SEQ ID NO: 3801 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (20)..(21): bicyclic nucleic acid (BNA)
acaucaaggaagauggcautt

SEQ ID NO: 3802 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
acaucaaggaagauggcatt

SEQ ID NO: 3803 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
acaucaaggaagauggcat

SEQ ID NO: 3804 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
acaucaaggaagauggca

SEQ ID NO: 3805 - RNA, 17 nt, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
acaucaaggaagauggc

SEQ ID NO: 3806 - RNA, 16 nt, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
acaucaaggaagaugg

SEQ ID NO: 3807 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
acaucaaggaagatg

SEQ ID NO: 3808 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
acaucaaggaagat

SEQ ID NO: 3809 - RNA, 13 nt, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
acaucaaggaaga

SEQ ID NO: 3810 - RNA, 12 nt, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
acaucaaggaag

SEQ ID NO: 3811 - RNA, 24 nt, Artificial Sequence
  Description of Artificial Sequence: Synthetic Antisense oligonucleotide
  misc_feature (1)..(2): bicyclic nucleic acid (BNA)
  misc_feature (23)..(24): bicyclic nucleic acid (BNA)
caucaaggaagauggcauuucuag

SEQ ID NO: 3812 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (22)..(23): bicyclic nucleic acid (BNA)
caucaaggaagauggcauuucta

SEQ ID NO: 3813 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (21)..(22): bicyclic nucleic acid (BNA)
caucaaggaagauggcauuuct

SEQ ID NO: 3814 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (20)..(21): bicyclic nucleic acid (BNA)
caucaaggaagauggcauutc

SEQ ID NO: 3815 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
caucaaggaagauggcautt

SEQ ID NO: 3816 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
caucaaggaagauggcatt

SEQ ID NO: 3817 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
caucaaggaagauggcat

SEQ ID NO: 3818 - RNA, 17 nt, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
caucaaggaagauggca

SEQ ID NO: 3819 - RNA, 16 nt, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
caucaaggaagauggc

SEQ ID NO: 3820 - RNA, 15 nt, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
caucaaggaagaugg

SEQ ID NO: 3821 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
caucaaggaagatg

SEQ ID NO: 3822 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
caucaaggaagat

SEQ ID NO: 3823 - RNA, 12 nt, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
caucaaggaaga

SEQ ID NO: 3824 - RNA, 11 nt, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
caucaaggaag

SEQ ID NO: 3825 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (22)..(23): bicyclic nucleic acid (BNA)
atcaaggaagauggcauuucuag

SEQ ID NO: 3826 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (21)..(22): bicyclic nucleic acid (BNA)
atcaaggaagauggcauuucta

SEQ ID NO: 3827 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (20)..(21): bicyclic nucleic acid (BNA)
atcaaggaagauggcauuuct

SEQ ID NO: 3828 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
atcaaggaagauggcauutc

SEQ ID NO: 3829 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
atcaaggaagauggcautt

SEQ ID NO: 3830 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
atcaaggaagauggcatt

SEQ ID NO: 3831 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
atcaaggaagauggcat

SEQ ID NO: 3832 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
atcaaggaagauggca

SEQ ID NO: 3833 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
atcaaggaagauggc

SEQ ID NO: 3834 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
atcaaggaagaugg

SEQ ID NO: 3835 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
atcaaggaagatg

SEQ ID NO: 3836 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
atcaaggaagat

SEQ ID NO: 3837 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
atcaaggaaga

SEQ ID NO: 3838 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
atcaaggaag

SEQ ID NO: 3839 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 3840 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 3841 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 3842 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
cuguccaagcccgguuga

SEQ ID NO: 3843 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (7)..(7): 5-methyl
  misc_feature (11)..(12): 5-methyl
taaguucuguccaag

SEQ ID NO: 3844 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(14): 5-methyl
tucuguccaagcccgguuga

SEQ ID NO: 3845 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(14): 5-methyl
tucuguccaagcccgguug

SEQ ID NO: 3846 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(14): 5-methyl
tucuguccaagcccgguu

SEQ ID NO: 3847 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(14): 5-methyl
tucuguccaagcccggu

SEQ ID NO: 3848 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(14): 5-methyl
tucuguccaagcccgg

SEQ ID NO: 3849 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(14): 5-methyl
tucuguccaagcccg

SEQ ID NO: 3850 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(14): 5-methyl
tucuguccaagccc

SEQ ID NO: 3851 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(13): 5-methyl
tucuguccaagcc

SEQ ID NO: 3852 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(12): 5-methyl
tucuguccaagc

SEQ ID NO: 3853 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (3)..(3): 5-methyl
  misc_feature (7)..(8): 5-methyl
tucuguccaag

SEQ ID NO: 3854 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (3)..(3): 5-methyl
  misc_feature (7)..(8): 5-methyl
tucuguccaa

SEQ ID NO: 3855 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (3)..(3): 5-methyl
  misc_feature (7)..(8): 5-methyl
tucugucca

SEQ ID NO: 3856 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (3)..(3): 5-methyl
  misc_feature (7)..(8): 5-methyl
tucugucc

SEQ ID NO: 3857 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(13): 5-methyl
tcuguccaagcccgguuga

SEQ ID NO: 3858 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(13): 5-methyl
tcuguccaagcccgguug

SEQ ID NO: 3859 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(13): 5-methyl
tcuguccaagcccgguu

SEQ ID NO: 3860 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(13): 5-methyl
tcuguccaagcccggu

SEQ ID NO: 3861 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(13): 5-methyl
tcuguccaagcccgg

SEQ ID NO: 3862 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(13): 5-methyl
tcuguccaagcccg

SEQ ID NO: 3863 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(13): 5-methyl
tcuguccaagccc

SEQ ID NO: 3864 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(12): 5-methyl
tcuguccaagcc

SEQ ID NO: 3865 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(11): 5-methyl
tcuguccaagc

SEQ ID NO: 3866 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (6)..(7): 5-methyl
tcuguccaag

SEQ ID NO: 3867 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (6)..(7): 5-methyl
tcuguccaa

SEQ ID NO: 3868 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (6)..(7): 5-methyl
tcugucca

SEQ ID NO: 3869 - RNA, 17 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
cuguccaagcccgguug

SEQ ID NO: 3870 - RNA, 16 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
cuguccaagcccgguu

SEQ ID NO: 3871 - RNA, 15 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
cuguccaagcccggu

SEQ ID NO: 3872 - RNA, 14 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
cuguccaagcccgg

SEQ ID NO: 3873 - RNA, 13 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
cuguccaagcccg

SEQ ID NO: 3874 - RNA, 12 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
cuguccaagccc

SEQ ID NO: 3875 - RNA, 11 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(11): 5-methyl
  misc_feature (1)..(1): bicyclic nucleic acid (BNA)
cuguccaagcc

SEQ ID NO: 3876 - RNA, 10 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(10): 5-methyl
  misc_feature (1)..(1): bicyclic nucleic acid (BNA)
cuguccaagc

SEQ ID NO: 3877 - RNA, 9 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (1)..(1): bicyclic nucleic acid (BNA)
cuguccaag

SEQ ID NO: 3878 - RNA, 8 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (1)..(1): bicyclic nucleic acid (BNA)
cuguccaa

SEQ ID NO: 3879 - RNA, 20 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
  misc_feature (13)..(15): 5-methyl
guucuguccaagcccgguug

SEQ ID NO: 3880 - RNA, 19 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
  misc_feature (13)..(15): 5-methyl
guucuguccaagcccgguu

SEQ ID NO: 3881 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
  misc_feature (13)..(15): 5-methyl
guucuguccaagcccggu

SEQ ID NO: 3882 - RNA, 17 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
  misc_feature (13)..(15): 5-methyl
guucuguccaagcccgg

SEQ ID NO: 3883 - RNA, 16 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
  misc_feature (13)..(15): 5-methyl
guucuguccaagcccg

SEQ ID NO: 3884 - RNA, 15 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
  misc_feature (13)..(15): 5-methyl
guucuguccaagccc

SEQ ID NO: 3885 - RNA, 14 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
  misc_feature (13)..(14): 5-methyl
guucuguccaagcc

SEQ ID NO: 3886 - RNA, 13 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
  misc_feature (13)..(13): 5-methyl
guucuguccaagc

SEQ ID NO: 3887 - RNA, 12 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
guucuguccaag

SEQ ID NO: 3888 - RNA, 11 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
guucuguccaa

SEQ ID NO: 3889 - RNA, 10 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
guucugucca

SEQ ID NO: 3890 - RNA, 9 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
guucugucc

SEQ ID NO: 3891 - RNA, 8 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(8): 5-methyl
guucuguc

SEQ ID NO: 3892 - RNA, 20 nt, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
  misc_feature (14)..(16): 5-methyl
aguucuguccaagcccgguu

SEQ ID NO: 3893 - RNA, 19 nt, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
  misc_feature (14)..(16): 5-methyl
aguucuguccaagcccggu

SEQ ID NO: 3894 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
  misc_feature (14)..(16): 5-methyl
aguucuguccaagcccgg

SEQ ID NO: 3895 - RNA, 17 nt, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
  misc_feature (14)..(16): 5-methyl
aguucuguccaagcccg

SEQ ID NO: 3896 - RNA, 16 nt, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
  misc_feature (14)..(16): 5-methyl
aguucuguccaagccc

SEQ ID NO: 3897 - RNA, 15 nt, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
  misc_feature (14)..(15): 5-methyl
aguucuguccaagcc

SEQ ID NO: 3898 - RNA, 14 nt, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
  misc_feature (14)..(14): 5-methyl
aguucuguccaagc

SEQ ID NO: 3899 - RNA, 13 nt, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
aguucuguccaag

SEQ ID NO: 3900 - RNA, 12 nt, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
aguucuguccaa

SEQ ID NO: 3901 - RNA, 11 nt, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
aguucugucca

SEQ ID NO: 3902 - RNA, 10 nt, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
aguucugucc

SEQ ID NO: 3903 - RNA, 9 nt, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(9): 5-methyl
aguucuguc

SEQ ID NO: 3904 - RNA, 8 nt, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
aguucugu

SEQ ID NO: 3905 - RNA, 20 nt, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
  misc_feature (15)..(17): 5-methyl
aaguucuguccaagcccggu

SEQ ID NO: 3906 - RNA, 19 nt, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
  misc_feature (15)..(17): 5-methyl
aaguucuguccaagcccgg

SEQ ID NO: 3907 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
  misc_feature (15)..(17): 5-methyl
aaguucuguccaagcccg

SEQ ID NO: 3908 - RNA, 17 nt, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
  misc_feature (15)..(17): 5-methyl
aaguucuguccaagccc

SEQ ID NO: 3909 - RNA, 16 nt, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
  misc_feature (15)..(16): 5-methyl
aaguucuguccaagcc

SEQ ID NO: 3910 - RNA, 15 nt, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
  misc_feature (15)..(15): 5-methyl
aaguucuguccaagc

SEQ ID NO: 3911 - RNA, 14 nt, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
aaguucuguccaag

SEQ ID NO: 3912 - RNA, 13 nt, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
aaguucuguccaa

SEQ ID NO: 3913 - RNA, 12 nt, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
aaguucugucca

SEQ ID NO: 3914 - RNA, 11 nt, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
aaguucugucc

SEQ ID NO: 3915 - RNA, 10 nt, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(10): 5-methyl
aaguucuguc

SEQ ID NO: 3916 - RNA, 9 nt, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
aaguucugu

SEQ ID NO: 3917 - RNA, 8 nt, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
aaguucug

SEQ ID NO: 3918 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (7)..(7): 5-methyl
  misc_feature (11)..(12): 5-methyl
  misc_feature (16)..(18): 5-methyl
taaguucuguccaagcccgg

SEQ ID NO: 3919 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (7)..(7): 5-methyl
  misc_feature (11)..(12): 5-methyl
  misc_feature (16)..(18): 5-methyl
taaguucuguccaagcccg

SEQ ID NO: 3920 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (7)..(7): 5-methyl
  misc_feature (11)..(12): 5-methyl
  misc_feature (16)..(18): 5-methyl
taaguucuguccaagccc

SEQ ID NO: 3921 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (7)..(7): 5-methyl
  misc_feature (11)..(12): 5-methyl
  misc_feature (16)..(17): 5-methyl
taaguucuguccaagcc

SEQ ID NO: 3922 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (7)..(7): 5-methyl
  misc_feature (11)..(12): 5-methyl
  misc_feature (16)..(16): 5-methyl
taaguucuguccaagc

SEQ ID NO: 3923 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (7)..(7): 5-methyl
  misc_feature (11)..(12): 5-methyl
taaguucuguccaa

SEQ ID NO: 3924 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (7)..(7): 5-methyl
  misc_feature (11)..(12): 5-methyl
taaguucugucca

SEQ ID NO: 3925 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (7)..(7): 5-methyl
  misc_feature (11)..(12): 5-methyl
taaguucugucc

SEQ ID NO: 3926 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (7)..(7): 5-methyl
  misc_feature (11)..(11): 5-methyl
taaguucuguc

SEQ ID NO: 3927 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (7)..(7): 5-methyl
taaguucugu

SEQ ID NO: 3928 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (7)..(7): 5-methyl
taaguucug

SEQ ID NO: 3929 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (7)..(7): 5-methyl
taaguucu

SEQ ID NO: 3930 - RNA, 20 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(13): 5-methyl
  misc_feature (17)..(19): 5-methyl
guaaguucuguccaagcccg

SEQ ID NO: 3931 - RNA, 19 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(13): 5-methyl
  misc_feature (17)..(19): 5-methyl
guaaguucuguccaagccc

SEQ ID NO: 3932 - RNA, 17 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(13): 5-methyl
  misc_feature (17)..(17): 5-methyl
guaaguucuguccaagc

SEQ ID NO: 3933 - RNA, 16 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(13): 5-methyl
guaaguucuguccaag

SEQ ID NO: 3934 - RNA, 15 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(13): 5-methyl
guaaguucuguccaa

SEQ ID NO: 3935 - RNA, 14 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(13): 5-methyl
guaaguucugucca

SEQ ID NO: 3936 - RNA, 13 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(13): 5-methyl
guaaguucugucc

SEQ ID NO: 3937 - RNA, 12 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(12): 5-methyl
guaaguucuguc

SEQ ID NO: 3938 - RNA, 11 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
guaaguucugu

SEQ ID NO: 3939 - RNA, 10 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
guaaguucug

SEQ ID NO: 3940 - RNA, 9 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
guaaguucu

SEQ ID NO: 3941 - RNA, 8 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
guaaguuc

SEQ ID NO: 3942 - RNA, 20 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (13)..(14): 5-methyl
  misc_feature (18)..(20): 5-methyl
gguaaguucuguccaagccc

SEQ ID NO: 3943 - RNA, 19 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (13)..(14): 5-methyl
  misc_feature (18)..(19): 5-methyl
gguaaguucuguccaagcc

SEQ ID NO: 3944 - RNA, 17 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (13)..(14): 5-methyl
gguaaguucuguccaag

SEQ ID NO: 3945 - RNA, 16 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (13)..(14): 5-methyl
gguaaguucuguccaa

SEQ ID NO: 3946 - RNA, 15 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (13)..(14): 5-methyl
gguaaguucugucca

SEQ ID NO: 3947 - RNA, 14 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (13)..(14): 5-methyl
gguaaguucugucc

SEQ ID NO: 3948 - RNA, 13 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (13)..(13): 5-methyl
gguaaguucuguc

SEQ ID NO: 3949 - RNA, 12 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
gguaaguucugu

SEQ ID NO: 3950 - RNA, 11 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
gguaaguucug

SEQ ID NO: 3951 - RNA, 10 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
gguaaguucu

SEQ ID NO: 3952 - RNA, 9 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
gguaaguuc

SEQ ID NO: 3953 - RNA, 20 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(20): 5-methyl
  misc_feature (1)..(1): bicyclic nucleic acid (BNA)
cgguaaguucuguccaagcc

SEQ ID NO: 3954 - RNA, 19 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(19): 5-methyl
  misc_feature (1)..(1): bicyclic nucleic acid (BNA)
cgguaaguucuguccaagc

SEQ ID NO: 3955 - RNA, 18 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(1): bicyclic nucleic acid (BNA)
cgguaaguucuguccaag

SEQ ID NO: 3956 - RNA, 17 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(1): bicyclic nucleic acid (BNA)
cgguaaguucuguccaa

SEQ ID NO: 3957 - RNA, 16 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(1): bicyclic nucleic acid (BNA)
cgguaaguucugucca

SEQ ID NO: 3958 - RNA, 15 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(1): bicyclic nucleic acid (BNA)
cgguaaguucugucc

SEQ ID NO: 3959 - RNA, 14 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(14): 5-methyl
  misc_feature (1)..(1): bicyclic nucleic acid (BNA)
cgguaaguucuguc

SEQ ID NO: 3960 - RNA, 13 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(1): bicyclic nucleic acid (BNA)
cgguaaguucugu

SEQ ID NO: 3961 - RNA, 12 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(1): bicyclic nucleic acid (BNA)
cgguaaguucug

SEQ ID NO: 3962 - RNA, 11 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(1): bicyclic nucleic acid (BNA)
cgguaaguucu

SEQ ID NO: 3963 - RNA, 10 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(1): bicyclic nucleic acid (BNA)
cgguaaguuc

SEQ ID NO: 3964 - RNA, 9 nt, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
cgguaaguu

SEQ ID NO: 3965 - RNA, 8 nt, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
cgguaagu

SEQ ID NO: 3966 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (11)..(11): 5-methyl
  misc_feature (15)..(16): 5-methyl
  misc_feature (20)..(20): 5-methyl
tcgguaaguucuguccaagc

SEQ ID NO: 3967 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (11)..(11): 5-methyl
  misc_feature (15)..(16): 5-methyl
tcgguaaguucuguccaag

SEQ ID NO: 3968 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (11)..(11): 5-methyl
  misc_feature (15)..(16): 5-methyl
tcgguaaguucuguccaa

SEQ ID NO: 3969 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (11)..(11): 5-methyl
  misc_feature (15)..(16): 5-methyl
tcgguaaguucugucca

SEQ ID NO: 3970 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (11)..(11): 5-methyl
  misc_feature (15)..(16): 5-methyl
tcgguaaguucugucc

SEQ ID NO: 3971 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (11)..(11): 5-methyl
  misc_feature (15)..(15): 5-methyl
tcgguaaguucuguc

SEQ ID NO: 3972 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (11)..(11): 5-methyl
tcgguaaguucugu

SEQ ID NO: 3973 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (11)..(11): 5-methyl
tcgguaaguucug

SEQ ID NO: 3974 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (11)..(11): 5-methyl
tcgguaaguucu

SEQ ID NO: 3975 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (11)..(11): 5-methyl
tcgguaaguuc

SEQ ID NO: 3976 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
tcgguaaguu

SEQ ID NO: 3977 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
tcgguaagu

SEQ ID NO: 3978 - RNA, 20 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
  misc_feature (16)..(17): 5-methyl
gucgguaaguucuguccaag

SEQ ID NO: 3979 - RNA, 19 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
  misc_feature (16)..(17): 5-methyl
gucgguaaguucuguccaa

SEQ ID NO: 3980 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
  misc_feature (16)..(17): 5-methyl
gucgguaaguucugucca

SEQ ID NO: 3981 - RNA, 17 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
  misc_feature (16)..(17): 5-methyl
gucgguaaguucugucc

SEQ ID NO: 3982 - RNA, 16 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
  misc_feature (16)..(16): 5-methyl
gucgguaaguucuguc

SEQ ID NO: 3983 - RNA, 15 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
gucgguaaguucugu

SEQ ID NO: 3984 - RNA, 14 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
gucgguaaguucug

SEQ ID NO: 3985 - RNA, 13 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
gucgguaaguucu

SEQ ID NO: 3986 - RNA, 12 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
gucgguaaguuc

SEQ ID NO: 3987 - RNA, 11 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
gucgguaaguu

SEQ ID NO: 3988 - RNA, 10 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
gucgguaagu

SEQ ID NO: 3989 - RNA, 20 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (13)..(13): 5-methyl
  misc_feature (17)..(18): 5-methyl
agucgguaaguucuguccaa

SEQ ID NO: 3990 - RNA, 19 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (13)..(13): 5-methyl
  misc_feature (17)..(18): 5-methyl
agucgguaaguucugucca

SEQ ID NO: 3991 - RNA, 17 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (13)..(13): 5-methyl
  misc_feature (17)..(17): 5-methyl
agucgguaaguucuguc

SEQ ID NO: 3992 - RNA, 16 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (13)..(13): 5-methyl
agucgguaaguucugu

SEQ ID NO: 3993 - RNA, 15 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (13)..(13): 5-methyl
agucgguaaguucug

SEQ ID NO: 3994 - RNA, 14 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (13)..(13): 5-methyl
agucgguaaguucu

SEQ ID NO: 3995 - RNA, 13 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (13)..(13): 5-methyl
agucgguaaguuc

SEQ ID NO: 3996 - RNA, 12 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
agucgguaaguu

SEQ ID NO: 3997 - RNA, 11 nt, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
agucgguaagu

SEQ ID NO: 3998 - RNA, 20 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (1)..(1): bicyclic nucleic acid (BNA)
cagucgguaaguucugucca

SEQ ID NO: 3999 - RNA, 19 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (1)..(1): bicyclic nucleic acid (BNA)
cagucgguaaguucugucc

SEQ ID NO: 4000 - RNA, 18 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(18): 5-methyl
  misc_feature (1)..(1): bicyclic nucleic acid (BNA)
cagucgguaaguucuguc

SEQ ID NO: 4001 - RNA, 17 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(1): bicyclic nucleic acid (BNA)
cagucgguaaguucugu

SEQ ID NO: 4002 - RNA, 16 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(1): bicyclic nucleic acid (BNA)
cagucgguaaguucug

SEQ ID NO: 4003 - RNA, 15 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(1): bicyclic nucleic acid (BNA)
cagucgguaaguucu

SEQ ID NO: 4004 - RNA, 14 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(1): bicyclic nucleic acid (BNA)
cagucgguaaguuc

SEQ ID NO: 4005 - RNA, 13 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (1)..(1): bicyclic nucleic acid (BNA)
cagucgguaaguu

SEQ ID NO: 4006 - RNA, 12 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (1)..(1): bicyclic nucleic acid (BNA)
cagucgguaagu

SEQ ID NO: 4007 - RNA, 20 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(20): 5-methyl
  misc_feature (1)..(1): bicyclic nucleic acid (BNA)
ccagucgguaaguucugucc

SEQ ID NO: 4008 - RNA, 19 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(19): 5-methyl
  misc_feature (1)..(1): bicyclic nucleic acid (BNA)
ccagucgguaaguucuguc

SEQ ID NO: 4009 - RNA, 18 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(1): bicyclic nucleic acid (BNA)
ccagucgguaaguucugu

SEQ ID NO: 4010 - RNA, 17 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(1): bicyclic nucleic acid (BNA)
ccagucgguaaguucug

SEQ ID NO: 4011 - RNA, 16 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(1): bicyclic nucleic acid (BNA)
ccagucgguaaguucu

SEQ ID NO: 4012 - RNA, 15 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(1): bicyclic nucleic acid (BNA)
ccagucgguaaguuc

SEQ ID NO: 4013 - RNA, 14 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (1)..(1): bicyclic nucleic acid (BNA)
ccagucgguaaguu

SEQ ID NO: 4014 - RNA, 13 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (1)..(1): bicyclic nucleic acid (BNA)
ccagucgguaagu

SEQ ID NO: 4015 - RNA, 20 nt, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (7)..(7): 5-methyl
  misc_feature (16)..(16): 5-methyl
  misc_feature (20)..(20): 5-methyl
gccagucgguaaguucuguc

SEQ ID NO: 4016 - RNA, 19 nt, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (7)..(7): 5-methyl
  misc_feature (16)..(16): 5-methyl
gccagucgguaaguucugu

SEQ ID NO: 4017 - RNA, 18 nt, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (7)..(7): 5-methyl
  misc_feature (16)..(16): 5-methyl
gccagucgguaaguucug

SEQ ID NO: 4018 - RNA, 17 nt, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (7)..(7): 5-methyl
  misc_feature (16)..(16): 5-methyl
gccagucgguaaguucu

SEQ ID NO: 4019 - RNA, 16 nt, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (7)..(7): 5-methyl
  misc_feature (16)..(16): 5-methyl
gccagucgguaaguuc

SEQ ID NO: 4020 - RNA, 15 nt, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (7)..(7): 5-methyl
gccagucgguaaguu

SEQ ID NO: 4021 - RNA, 14 nt, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (7)..(7): 5-methyl
gccagucgguaagu

SEQ ID NO: 4022 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 4023 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 4024 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (14)..(14): 5-methyl
tcaaggaagauggcau

SEQ ID NO: 4025 - RNA, 15 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (14)..(14): 5-methyl
gaagauggcauuucu

SEQ ID NO: 4026 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucua

SEQ ID NO: 4027 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuc

SEQ ID NO: 4028 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (14)..(14): 5-methyl
tcaaggaagauggcauuu

SEQ ID NO: 4029 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (14)..(14): 5-methyl
tcaaggaagauggcauu

SEQ ID NO: 4030 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (14)..(14): 5-methyl
tcaaggaagauggca

SEQ ID NO: 4031 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (14)..(14): 5-methyl
tcaaggaagauggc

SEQ ID NO: 4032 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
tcaaggaagaugg

SEQ ID NO: 4033 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
tcaaggaagaug

SEQ ID NO: 4034 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
tcaaggaagau

SEQ ID NO: 4035 - DNA, 10 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
tcaaggaaga

SEQ ID NO: 4036 - DNA, 9 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
tcaaggaag

SEQ ID NO: 4037 - RNA, 21 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(1): bicyclic nucleic acid (BNA)
caaggaagauggcauuucuag

SEQ ID NO: 4038 - RNA, 20 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(1): bicyclic nucleic acid (BNA)
caaggaagauggcauuucua

SEQ ID NO: 4039 - RNA, 19 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(1): bicyclic nucleic acid (BNA)
caaggaagauggcauuucu

SEQ ID NO: 4040 - RNA, 18 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(1): bicyclic nucleic acid (BNA)
caaggaagauggcauuuc

SEQ ID NO: 4041 - RNA, 17 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(1): bicyclic nucleic acid (BNA)
caaggaagauggcauuu

SEQ ID NO: 4042 - RNA, 16 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(1): bicyclic nucleic acid (BNA)
caaggaagauggcauu

SEQ ID NO: 4043 - RNA, 15 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(1): bicyclic nucleic acid (BNA)
caaggaagauggcau

SEQ ID NO: 4044 - RNA, 14 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(1): bicyclic nucleic acid (BNA)
caaggaagauggca

SEQ ID NO: 4045 - RNA, 13 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(1): bicyclic nucleic acid (BNA)
caaggaagauggc

SEQ ID NO: 4046 - RNA, 12 nt, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
caaggaagaugg

SEQ ID NO: 4047 - RNA, 11 nt, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
caaggaagaug

SEQ ID NO: 4048 - RNA, 10 nt, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
caaggaagau

SEQ ID NO: 4049 - RNA, 9 nt, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
caaggaaga

SEQ ID NO: 4050 - RNA, 8 nt, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
caaggaag

SEQ ID NO: 4051 - RNA, 20 nt, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
  misc_feature (17)..(17): 5-methyl
aaggaagauggcauuucuag

SEQ ID NO: 4052 - RNA, 19 nt, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
  misc_feature (17)..(17): 5-methyl
aaggaagauggcauuucua

SEQ ID NO: 4053 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
  misc_feature (17)..(17): 5-methyl
aaggaagauggcauuucu

SEQ ID NO: 4054 - RNA, 17 nt, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
  misc_feature (17)..(17): 5-methyl
aaggaagauggcauuuc

SEQ ID NO: 4055 - RNA, 16 nt, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
aaggaagauggcauuu

SEQ ID NO: 4056 - RNA, 15 nt, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
aaggaagauggcauu

SEQ ID NO: 4057 - RNA, 14 nt, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
aaggaagauggcau

SEQ ID NO: 4058 - RNA, 13 nt, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
aaggaagauggca

SEQ ID NO: 4059 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
aaggaagauggc

SEQ ID NO: 4060 - RNA, 19 nt, Artificial Sequence
  Description of Artificial Sequence: Synthetic Antisense oligonucleotide
  misc_feature (1)..(1): bicyclic nucleic acid (BNA)
  misc_feature (11)..(11): 5-methyl
  misc_feature (16)..(16): 5-methyl
aggaagauggcauuucuag

SEQ ID NO: 4061 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): 5-methyl
  misc_feature (16)..(16): 5-methyl
aggaagauggcauuucua

SEQ ID NO: 4062 - RNA, 17 nt, Artificial Sequence
  Description of Artificial Sequence: Synthetic Antisense oligonucleotide
  misc_feature (1)..(1): bicyclic nucleic acid (BNA)
  misc_feature (11)..(11): 5-methyl
  misc_feature (16)..(16): 5-methyl
aggaagauggcauuucu

SEQ ID NO: 4063 - RNA, 16 nt, Artificial Sequence
  Description of Artificial Sequence: Synthetic Antisense oligonucleotide
  misc_feature (1)..(1): bicyclic nucleic acid (BNA)
  misc_feature (11)..(11): 5-methyl
  misc_feature (16)..(16): 5-methyl
aggaagauggcauuuc

SEQ ID NO: 4064 - RNA, 15 nt, Artificial Sequence
  Description of Artificial Sequence: Synthetic Antisense oligonucleotide
  misc_feature (1)..(1): bicyclic nucleic acid (BNA)
  misc_feature (11)..(11): 5-methyl
aggaagauggcauuu

SEQ ID NO: 4065 - RNA, 14 nt, Artificial Sequence
  Description of Artificial Sequence: Synthetic Antisense oligonucleotide
  misc_feature (1)..(1): bicyclic nucleic acid (BNA)
  misc_feature (11)..(11): 5-methyl
aggaagauggcauu

SEQ ID NO: 4066 - RNA, 13 nt, Artificial Sequence
  Description of Artificial Sequence: Synthetic Antisense oligonucleotide
  misc_feature (1)..(1): bicyclic nucleic acid (BNA)
  misc_feature (11)..(11): 5-methyl
aggaagauggcau

SEQ ID NO: 4067 - RNA, 12 nt, Artificial Sequence
  Description of Artificial Sequence: Synthetic Antisense oligonucleotide
  misc_feature (1)..(1): bicyclic nucleic acid (BNA)
  misc_feature (11)..(11): 5-methyl
aggaagauggca

SEQ ID NO: 4068 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
  misc_feature (15)..(15): 5-methyl
ggaagauggcauuucuag

SEQ ID NO: 4069 - RNA, 17 nt, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
  misc_feature (15)..(15): 5-methyl
ggaagauggcauuucua

SEQ ID NO: 4070 - RNA, 16 nt, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
  misc_feature (15)..(15): 5-methyl
ggaagauggcauuucu

SEQ ID NO: 4071 - RNA, 15 nt, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
  misc_feature (15)..(15): 5-methyl
ggaagauggcauuuc

SEQ ID NO: 4072 - RNA, 14 nt, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
ggaagauggcauuu

SEQ ID NO: 4073 - RNA, 13 nt, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
ggaagauggcauu

SEQ ID NO: 4074 - RNA, 12 nt, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
ggaagauggcau

SEQ ID NO: 4075 - RNA, 11 nt, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
ggaagauggca

SEQ ID NO: 4076 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
ggaagauggc

SEQ ID NO: 4077 - RNA, 17 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (14)..(14): 5-methyl
gaagauggcauuucuag

SEQ ID NO: 4078 - RNA, 16 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (14)..(14): 5-methyl
gaagauggcauuucua

SEQ ID NO: 4079 - RNA, 14 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (14)..(14): 5-methyl
gaagauggcauuuc

SEQ ID NO: 4080 - RNA, 13 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
gaagauggcauuu

SEQ ID NO: 4081 - RNA, 12 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
gaagauggcauu

SEQ ID NO: 4082 - RNA, 11 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
gaagauggcau

SEQ ID NO: 4083 - RNA, 10 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
gaagauggca

SEQ ID NO: 4084 - RNA, 9 nt, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
gaagauggc

SEQ ID NO: 4085 - RNA, 16 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (13)..(13): 5-methyl
aagauggcauuucuag

SEQ ID NO: 4086 - RNA, 15 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (13)..(13): 5-methyl
aagauggcauuucua

SEQ ID NO: 4087 - RNA, 14 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (13)..(13): 5-methyl
aagauggcauuucu

SEQ ID NO: 4088 - RNA, 13 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (13)..(13): 5-methyl
aagauggcauuuc

SEQ ID NO: 4089 - RNA, 12 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
aagauggcauuu

SEQ ID NO: 4090 - RNA, 11 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
aagauggcauu

SEQ ID NO: 4091 - RNA, 10 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
aagauggcau

SEQ ID NO: 4092 - RNA, 9 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
aagauggca

SEQ ID NO: 4093 - RNA, 8 nt, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
aagauggc

SEQ ID NO: 4094 - RNA, 15 nt, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (12)..(12): 5-methyl
agauggcauuucuag

SEQ ID NO: 4095 - RNA, 14 nt, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (12)..(12): 5-methyl
agauggcauuucua

SEQ ID NO: 4096 - RNA, 13 nt, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (12)..(12): 5-methyl
agauggcauuucu

SEQ ID NO: 4097 - RNA, 12 nt, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (12)..(12): 5-methyl
agauggcauuuc

SEQ ID NO: 4098 - RNA, 11 nt, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
agauggcauuu

SEQ ID NO: 4099 - RNA, 10 nt, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
agauggcauu

SEQ ID NO: 4100 - RNA, 9 nt, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
agauggcau

SEQ ID NO: 4101 - RNA, 8 nt, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
agauggca

SEQ ID NO: 4102 - RNA, 30 nt, Artificial Sequence; identical to SEQ ID NO: 287
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(1): bicyclic nucleic acid (BNA)

SEQ ID NO: 4103 - RNA, 29 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(1): bicyclic nucleic acid (BNA)
cuccaacaucaaggaagauggcauuucua

SEQ ID NO: 4104 - RNA, 28 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(1): bicyclic nucleic acid (BNA)
cuccaacaucaaggaagauggcauuucu

SEQ ID NO: 4105 - RNA, 27 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(1): bicyclic nucleic acid (BNA)
cuccaacaucaaggaagauggcauuuc

SEQ ID NO: 4106 - RNA, 26 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
cuccaacaucaaggaagauggcauuu

SEQ ID NO: 4107 - RNA, 25 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
cuccaacaucaaggaagauggcauu

SEQ ID NO: 4108 - RNA, 24 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
cuccaacaucaaggaagauggcau

SEQ ID NO: 4109 - RNA, 23 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
cuccaacaucaaggaagauggca

SEQ ID NO: 4110 - RNA, 22 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
cuccaacaucaaggaagauggc

SEQ ID NO: 4111 - RNA, 21 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
cuccaacaucaaggaagaugg

SEQ ID NO: 4112 - RNA, 20 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
cuccaacaucaaggaagaug

SEQ ID NO: 4113 - RNA, 19 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
cuccaacaucaaggaagau

SEQ ID NO: 4114 - RNA, 18 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
cuccaacaucaaggaaga

SEQ ID NO: 4115 - RNA, 17 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
cuccaacaucaaggaag

SEQ ID NO: 4116 - DNA, 29 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacaucaaggaagauggcauuucuag

SEQ ID NO: 4117 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacaucaaggaagauggcauuucua

SEQ ID NO: 4118 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacaucaaggaagauggcauuucu

SEQ ID NO: 4119 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacaucaaggaagauggcauuuc

SEQ ID NO: 4120 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggcauuu

SEQ ID NO: 4121 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggcauu

SEQ ID NO: 4122 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggcau

SEQ ID NO: 4123 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggca

SEQ ID NO: 4124 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggc

SEQ ID NO: 4125 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
tccaacaucaaggaagaugg

SEQ ID NO: 4126 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
tccaacaucaaggaagaug

SEQ ID NO: 4127 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
tccaacaucaaggaagau

SEQ ID NO: 4128 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
tccaacaucaaggaaga

SEQ ID NO: 4129 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
tccaacaucaaggaag

SEQ ID NO: 4130 - RNA, 28 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(1): bicyclic nucleic acid (BNA)
ccaacaucaaggaagauggcauuucuag

SEQ ID NO: 4131 - RNA, 27 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(1): bicyclic nucleic acid (BNA)
ccaacaucaaggaagauggcauuucua

SEQ ID NO: 4132 - RNA, 26 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(1): bicyclic nucleic acid (BNA)
ccaacaucaaggaagauggcauuucu

SEQ ID NO: 4133 - RNA, 25 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(1): bicyclic nucleic acid (BNA)
ccaacaucaaggaagauggcauuuc

SEQ ID NO: 4134 - RNA, 24 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
ccaacaucaaggaagauggcauuu

SEQ ID NO: 4135 - RNA, 23 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
ccaacaucaaggaagauggcauu

SEQ ID NO: 4136 - RNA, 22 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
ccaacaucaaggaagauggcau

SEQ ID NO: 4137 - RNA, 21 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
ccaacaucaaggaagauggca

SEQ ID NO: 4138 - RNA, 20 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
ccaacaucaaggaagauggc

SEQ ID NO: 4139 - RNA, 19 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
ccaacaucaaggaagaugg

SEQ ID NO: 4140 - RNA, 18 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
ccaacaucaaggaagaug

SEQ ID NO: 4141 - RNA, 17 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
ccaacaucaaggaagau

SEQ ID NO: 4142 - RNA, 16 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
ccaacaucaaggaaga

SEQ ID NO: 4143 - RNA, 15 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
ccaacaucaaggaag

SEQ ID NO: 4144 - RNA, 27 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(1): bicyclic nucleic acid (BNA)
caacaucaaggaagauggcauuucuag

SEQ ID NO: 4145 - RNA, 26 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(1): bicyclic nucleic acid (BNA)
caacaucaaggaagauggcauuucua

SEQ ID NO: 4146 - RNA, 25 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(1): bicyclic nucleic acid (BNA)
caacaucaaggaagauggcauuucu

SEQ ID NO: 4147 - RNA, 24 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(1): bicyclic nucleic acid (BNA)
caacaucaaggaagauggcauuuc

SEQ ID NO: 4148 - RNA, 23 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
caacaucaaggaagauggcauuu

SEQ ID NO: 4149 - RNA, 22 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
caacaucaaggaagauggcauu

SEQ ID NO: 4150 - RNA, 21 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
caacaucaaggaagauggcau

SEQ ID NO: 4151 - RNA, 20 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
caacaucaaggaagauggca

SEQ ID NO: 4152 - RNA, 19 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
caacaucaaggaagauggc

SEQ ID NO: 4153 - RNA, 18 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
caacaucaaggaagaugg

SEQ ID NO: 4154 - RNA, 17 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
caacaucaaggaagaug

SEQ ID NO: 4155 - RNA, 16 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
caacaucaaggaagau

SEQ ID NO: 4156 - RNA, 15 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
caacaucaaggaaga

SEQ ID NO: 4157 - RNA, 14 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
caacaucaaggaag

SEQ ID NO: 4158 - RNA, 26 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuucuag

SEQ ID NO: 4159 - RNA, 25 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuucua

SEQ ID NO: 4160 - RNA, 24 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuucu

SEQ ID NO: 4161 - RNA, 23 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuuc

SEQ ID NO: 4162 - RNA, 22 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
aacaucaaggaagauggcauuu

SEQ ID NO: 4163 - RNA, 21 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
aacaucaaggaagauggcauu

SEQ ID NO: 4164 - RNA, 20 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
aacaucaaggaagauggcau

SEQ ID NO: 4165 - RNA, 19 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
aacaucaaggaagauggca

SEQ ID NO: 4166 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
aacaucaaggaagauggc

SEQ ID NO: 4167 - RNA, 17 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
aacaucaaggaagaugg

SEQ ID NO: 4168 - RNA, 16 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
aacaucaaggaagaug

SEQ ID NO: 4169 - RNA, 15 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
aacaucaaggaagau

SEQ ID NO: 4170 - RNA, 14 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
aacaucaaggaaga

SEQ ID NO: 4171 - RNA, 13 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
aacaucaaggaag

SEQ ID NO: 4172 - RNA, 25 nt, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuucuag

SEQ ID NO: 4173 - RNA, 24 nt, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuucua

SEQ ID NO: 4174 - RNA, 23 nt, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuucu

SEQ ID NO: 4175 - RNA, 22 nt, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuuc

SEQ ID NO: 4176 - RNA, 21 nt, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
acaucaaggaagauggcauuu

SEQ ID NO: 4177 - RNA, 20 nt, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
acaucaaggaagauggcauu

SEQ ID NO: 4178 - RNA, 19 nt, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
acaucaaggaagauggcau

SEQ ID NO: 4179 - RNA, 18 nt, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
acaucaaggaagauggca

SEQ ID NO: 4180 - RNA, 17 nt, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
acaucaaggaagauggc

SEQ ID NO: 4181 - RNA, 16 nt, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
acaucaaggaagaugg

SEQ ID NO: 4182 - RNA, 15 nt, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
acaucaaggaagaug

SEQ ID NO: 4183 - RNA, 14 nt, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
acaucaaggaagau

SEQ ID NO: 4184 - RNA, 13 nt, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
acaucaaggaaga

SEQ ID NO: 4185 - RNA, 12 nt, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
acaucaaggaag

SEQ ID NO: 4186 - RNA, 24 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(1): bicyclic nucleic acid (BNA)
caucaaggaagauggcauuucuag

SEQ ID NO: 4187 - RNA, 23 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(1): bicyclic nucleic acid (BNA)
caucaaggaagauggcauuucua

SEQ ID NO: 4188 - RNA, 22 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(1): bicyclic nucleic acid (BNA)
caucaaggaagauggcauuucu

SEQ ID NO: 4189 - RNA, 21 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(1): bicyclic nucleic acid (BNA)
caucaaggaagauggcauuuc

SEQ ID NO: 4190 - RNA, 20 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
caucaaggaagauggcauuu

SEQ ID NO: 4191 - RNA, 19 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
caucaaggaagauggcauu

SEQ ID NO: 4192 - RNA, 18 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
caucaaggaagauggcau

SEQ ID NO: 4193 - RNA, 17 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
caucaaggaagauggca

SEQ ID NO: 4194 - RNA, 16 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
caucaaggaagauggc

SEQ ID NO: 4195 - RNA, 15 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
caucaaggaagaugg

SEQ ID NO: 4196 - RNA, 14 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
caucaaggaagaug

SEQ ID NO: 4197 - RNA, 13 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
caucaaggaagau

SEQ ID NO: 4198 - RNA, 12 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
caucaaggaaga

SEQ ID NO: 4199 - RNA, 11 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
caucaaggaag

SEQ ID NO: 4200 - RNA, 23 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
  misc_feature (20)..(20): 5-methyl
aucaaggaagauggcauuucuag

SEQ ID NO: 4201 - RNA, 22 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
  misc_feature (20)..(20): 5-methyl
aucaaggaagauggcauuucua

SEQ ID NO: 4202 - RNA, 21 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
  misc_feature (20)..(20): 5-methyl
aucaaggaagauggcauuucu

SEQ ID NO: 4203 - RNA, 20 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
  misc_feature (20)..(20): 5-methyl
aucaaggaagauggcauuuc

SEQ ID NO: 4204 - RNA, 19 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
aucaaggaagauggcauuu

SEQ ID NO: 4205 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
aucaaggaagauggcauu

SEQ ID NO: 4206 - RNA, 17 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
aucaaggaagauggcau

SEQ ID NO: 4207 - RNA, 16 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
aucaaggaagauggca

SEQ ID NO: 4208 - RNA, 15 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
aucaaggaagauggc

SEQ ID NO: 4209 - RNA, 14 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
aucaaggaagaugg

SEQ ID NO: 4210 - RNA, 13 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
aucaaggaagaug

SEQ ID NO: 4211 - RNA, 12 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
aucaaggaagau

SEQ ID NO: 4212 - RNA, 11 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
aucaaggaaga

SEQ ID NO: 4213 - RNA, 10 nt, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
aucaaggaag

SEQ ID NO: 4214 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (18)..(18): bicyclic nucleic acid (BNA)
gguaaguucuguccaagc

SEQ ID NO: 4215 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (18)..(18): bicyclic nucleic acid (BNA)
guaaguucuguccaagcc

SEQ ID NO: 4216 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (18)..(18): bicyclic nucleic acid (BNA)
agucgguaaguucugucc

SEQ ID NO: 4217 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (18)..(18): bicyclic nucleic acid (BNA)
cuguccaagcccgguuga

SEQ ID NO: 4218 - RNA, 15 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (15)..(15): bicyclic nucleic acid (BNA)
uaaguucuguccaag

SEQ ID NO: 4219 - RNA, 20 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (20)..(20): bicyclic nucleic acid (BNA)
uucuguccaagcccgguuga

SEQ ID NO: 4220 - RNA, 19 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (19)..(19): bicyclic nucleic acid (BNA)
uucuguccaagcccgguug

SEQ ID NO: 4221 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (7)..(8): 5-methyl
  misc_feature (12)..(14): 5-methyl
  misc_feature (18)..(18): bicyclic nucleic acid (BNA)
uucuguccaagcccggut

SEQ ID NO: 4222 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (7)..(8): 5-methyl
  misc_feature (12)..(14): 5-methyl
  misc_feature (17)..(17): bicyclic nucleic acid (BNA)
uucuguccaagcccggt

SEQ ID NO: 4223 - RNA, 16 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (16)..(16): bicyclic nucleic acid (BNA)
uucuguccaagcccgg

SEQ ID NO: 4224 - RNA, 15 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (15)..(15): bicyclic nucleic acid (BNA)
uucuguccaagcccg

SEQ ID NO: 4225 - RNA, 14 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (14)..(14): bicyclic nucleic acid (BNA)
uucuguccaagccc

SEQ ID NO: 4226 - RNA, 13 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(13): 5-methyl
  misc_feature (13)..(13): bicyclic nucleic acid (BNA)
uucuguccaagcc

SEQ ID NO: 4227 - RNA, 12 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(12): 5-methyl
  misc_feature (12)..(12): bicyclic nucleic acid (BNA)
uucuguccaagc

SEQ ID NO: 4228 - RNA, 11 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (11)..(11): bicyclic nucleic acid (BNA)
uucuguccaag

SEQ ID NO: 4229 - RNA, 10 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (10)..(10): bicyclic nucleic acid (BNA)
uucuguccaa

SEQ ID NO: 4230 - RNA, 9 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (9)..(9): bicyclic nucleic acid (BNA)
uucugucca

SEQ ID NO: 4231 - RNA, 8 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (8)..(8): bicyclic nucleic acid (BNA)
uucugucc

SEQ ID NO: 4232 - RNA, 19 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (19)..(19): bicyclic nucleic acid (BNA)
ucuguccaagcccgguuga

SEQ ID NO: 4233 - RNA, 18 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (18)..(18): bicyclic nucleic acid (BNA)
ucuguccaagcccgguug

SEQ ID NO: 4234 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (6)..(7): 5-methyl
  misc_feature (11)..(13): 5-methyl
  misc_feature (17)..(17): bicyclic nucleic acid (BNA)
ucuguccaagcccggut

SEQ ID NO: 4235 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (6)..(7): 5-methyl
  misc_feature (11)..(13): 5-methyl
  misc_feature (16)..(16): bicyclic nucleic acid (BNA)
ucuguccaagcccggt

SEQ ID NO: 4236 - RNA, 15 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (15)..(15): bicyclic nucleic acid (BNA)
ucuguccaagcccgg

SEQ ID NO: 4237 - RNA, 14 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (14)..(14): bicyclic nucleic acid (BNA)
ucuguccaagcccg

SEQ ID NO: 4238 - RNA, 13 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (13)..(13): bicyclic nucleic acid (BNA)
ucuguccaagccc

SEQ ID NO: 4239 - RNA, 12 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(12): 5-methyl
  misc_feature (12)..(12): bicyclic nucleic acid (BNA)
ucuguccaagcc

SEQ ID NO: 4240 - RNA, 11 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(11): 5-methyl
  misc_feature (11)..(11): bicyclic nucleic acid (BNA)
ucuguccaagc

SEQ ID NO: 4241 - RNA, 10 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (10)..(10): bicyclic nucleic acid (BNA)
ucuguccaag

SEQ ID NO: 4242 - RNA, 9 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (9)..(9): bicyclic nucleic acid (BNA)
ucuguccaa

SEQ ID NO: 4243 - RNA, 8 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (8)..(8): bicyclic nucleic acid (BNA)
ucugucca

SEQ ID NO: 4244 - RNA, 17 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (17)..(17): bicyclic nucleic acid (BNA)
cuguccaagcccgguug

SEQ ID NO: 4245 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (16)..(16): bicyclic nucleic acid (BNA)
cuguccaagcccggut

SEQ ID NO: 4246 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (15)..(15): bicyclic nucleic acid (BNA)
cuguccaagcccggt

SEQ ID NO: 4247 - RNA, 14 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (14)..(14): bicyclic nucleic acid (BNA)
cuguccaagcccgg

SEQ ID NO: 4248 - RNA, 13 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(13): bicyclic nucleic acid (BNA)
cuguccaagcccg

SEQ ID NO: 4249 - RNA, 12 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(12): bicyclic nucleic acid (BNA)
cuguccaagccc

SEQ ID NO: 4250 - RNA, 11 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(11): 5-methyl
  misc_feature (11)..(11): bicyclic nucleic acid (BNA)
cuguccaagcc

SEQ ID NO: 4251 - RNA, 10 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(10): 5-methyl
  misc_feature (10)..(10): bicyclic nucleic acid (BNA)
cuguccaagc

SEQ ID NO: 4252 - RNA, 9 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (9)..(9): bicyclic nucleic acid (BNA)
cuguccaag

SEQ ID NO: 4253 - RNA, 8 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (8)..(8): bicyclic nucleic acid (BNA)
cuguccaa

SEQ ID NO: 4254 - RNA, 20 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (20)..(20): bicyclic nucleic acid (BNA)
guucuguccaagcccgguug

SEQ ID NO: 4255 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (4)..(4): 5-methyl
  misc_feature (8)..(9): 5-methyl
  misc_feature (13)..(15): 5-methyl
  misc_feature (19)..(19): bicyclic nucleic acid (BNA)
guucuguccaagcccggut

SEQ ID NO: 4256 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (4)..(4): 5-methyl
  misc_feature (8)..(9): 5-methyl
  misc_feature (13)..(15): 5-methyl
  misc_feature (18)..(18): bicyclic nucleic acid (BNA)
guucuguccaagcccggt

SEQ ID NO: 4257 - RNA, 17 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (17)..(17): bicyclic nucleic acid (BNA)
guucuguccaagcccgg

SEQ ID NO: 4258 - RNA, 16 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (16)..(16): bicyclic nucleic acid (BNA)
guucuguccaagcccg

SEQ ID NO: 4259 - RNA, 15 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (15)..(15): bicyclic nucleic acid (BNA)
guucuguccaagccc

SEQ ID NO: 4260 - RNA, 14 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(14): 5-methyl
  misc_feature (14)..(14): bicyclic nucleic acid (BNA)
guucuguccaagcc

SEQ ID NO: 4261 - RNA, 13 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(13): 5-methyl
  misc_feature (13)..(13): bicyclic nucleic acid (BNA)
guucuguccaagc

SEQ ID NO: 4262 - RNA, 12 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (12)..(12): bicyclic nucleic acid (BNA)
guucuguccaag

SEQ ID NO: 4263 - RNA, 11 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (11)..(11): bicyclic nucleic acid (BNA)
guucuguccaa

SEQ ID NO: 4264 - RNA, 10 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (10)..(10): bicyclic nucleic acid (BNA)
guucugucca

SEQ ID NO: 4265 - RNA, 9 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (9)..(9): bicyclic nucleic acid (BNA)
guucugucc

SEQ ID NO: 4266 - RNA, 8 nt, Artificial Sequence
  Description of Artificial Sequence: Synthetic Antisense oligonucleotide
  misc_feature (4)..(4): 5-methyl
  misc_feature (8)..(8): 5-methyl
  misc_feature (8)..(8): bicyclic nucleic acid (BNA)
guucuguc

SEQ ID NO: 4267 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(5): 5-methyl
  misc_feature (9)..(10): 5-methyl
  misc_feature (14)..(16): 5-methyl
  misc_feature (20)..(20): bicyclic nucleic acid (BNA)
aguucuguccaagcccggut

SEQ ID NO: 4268 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(5): 5-methyl
  misc_feature (9)..(10): 5-methyl
  misc_feature (14)..(16): 5-methyl
  misc_feature (19)..(19): bicyclic nucleic acid (BNA)
aguucuguccaagcccggt

SEQ ID NO: 4269 - RNA, 18 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
  misc_feature (18)..(18): bicyclic nucleic acid (BNA)
aguucuguccaagcccgg

SEQ ID NO: 4270 - RNA, 17 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
  misc_feature (17)..(17): bicyclic nucleic acid (BNA)
aguucuguccaagcccg

SEQ ID NO: 4271 - RNA, 16 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
  misc_feature (16)..(16): bicyclic nucleic acid (BNA)
aguucuguccaagccc

SEQ ID NO: 4272 - RNA, 15 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(15): 5-methyl
  misc_feature (15)..(15): bicyclic nucleic acid (BNA)
aguucuguccaagcc

SEQ ID NO: 4273 - RNA, 14 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(14): 5-methyl
  misc_feature (14)..(14): bicyclic nucleic acid (BNA)
aguucuguccaagc

SEQ ID NO: 4274 - RNA, 13 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (13)..(13): bicyclic nucleic acid (BNA)
aguucuguccaag

SEQ ID NO: 4275 - RNA, 12 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (12)..(12): bicyclic nucleic acid (BNA)
aguucuguccaa

SEQ ID NO: 4276 - RNA, 11 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (11)..(11): bicyclic nucleic acid (BNA)
aguucugucca

SEQ ID NO: 4277 - RNA, 10 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (10)..(10): bicyclic nucleic acid (BNA)
aguucugucc

SEQ ID NO: 4278 - RNA, 9 nt, Artificial Sequence
  Description of Artificial Sequence: Synthetic Antisense oligonucleotide
  misc_feature (5)..(5): 5-methyl
  misc_feature (9)..(9): 5-methyl
  misc_feature (9)..(9): bicyclic nucleic acid (BNA)
aguucuguc

SEQ ID NO: 4279 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(5): 5-methyl
  misc_feature (8)..(8): bicyclic nucleic acid (BNA)
aguucugt

SEQ ID NO: 4280 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (6)..(6): 5-methyl
  misc_feature (10)..(11): 5-methyl
  misc_feature (15)..(17): 5-methyl
  misc_feature (20)..(20): bicyclic nucleic acid (BNA)
aaguucuguccaagcccggt

SEQ ID NO: 4281 - RNA, 19 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
  misc_feature (19)..(19): bicyclic nucleic acid (BNA)
aaguucuguccaagcccgg

SEQ ID NO: 4282 - RNA, 18 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
  misc_feature (18)..(18): bicyclic nucleic acid (BNA)
aaguucuguccaagcccg

SEQ ID NO: 4283 - RNA, 17 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
  misc_feature (17)..(17): bicyclic nucleic acid (BNA)
aaguucuguccaagccc

SEQ ID NO: 4284 - RNA, 16 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(16): 5-methyl
  misc_feature (16)..(16): bicyclic nucleic acid (BNA)
aaguucuguccaagcc

SEQ ID NO: 4285 - RNA, 15 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(15): 5-methyl
  misc_feature (15)..(15): bicyclic nucleic acid (BNA)
aaguucuguccaagc

SEQ ID NO: 4286 - RNA, 14 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (14)..(14): bicyclic nucleic acid (BNA)
aaguucuguccaag

SEQ ID NO: 4287 - RNA, 13 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (13)..(13): bicyclic nucleic acid (BNA)
aaguucuguccaa

SEQ ID NO: 4288 - RNA, 12 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (12)..(12): bicyclic nucleic acid (BNA)
aaguucugucca

SEQ ID NO: 4289 - RNA, 11 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (11)..(11): bicyclic nucleic acid (BNA)
aaguucugucc

SEQ ID NO: 4290 - RNA, 10 nt, Artificial Sequence
  Description of Artificial Sequence: Synthetic Antisense oligonucleotide
  misc_feature (6)..(6): 5-methyl
  misc_feature (10)..(10): 5-methyl
  misc_feature (10)..(10): bicyclic nucleic acid (BNA)
aaguucuguc

SEQ ID NO: 4291 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (6)..(6): 5-methyl
  misc_feature (9)..(9): bicyclic nucleic acid (BNA)
aaguucugt

SEQ ID NO: 4292 - RNA, 8 nt, Artificial Sequence
  Description of Artificial Sequence: Synthetic Antisense oligonucleotide
  misc_feature (6)..(6): 5-methyl
  misc_feature (8)..(8): bicyclic nucleic acid (BNA)
aaguucug

SEQ ID NO: 4293 - RNA, 20 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
  misc_feature (20)..(20): bicyclic nucleic acid (BNA)
uaaguucuguccaagcccgg

SEQ ID NO: 4294 - RNA, 19 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
  misc_feature (19)..(19): bicyclic nucleic acid (BNA)
uaaguucuguccaagcccg

SEQ ID NO: 4295 - RNA, 18 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
  misc_feature (18)..(18): bicyclic nucleic acid (BNA)
uaaguucuguccaagccc

SEQ ID NO: 4296 - RNA, 17 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(17): 5-methyl
  misc_feature (17)..(17): bicyclic nucleic acid (BNA)
uaaguucuguccaagcc

SEQ ID NO: 4297 - RNA, 16 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(16): 5-methyl
  misc_feature (16)..(16): bicyclic nucleic acid (BNA)
uaaguucuguccaagc

SEQ ID NO: 4298 - RNA, 14 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (14)..(14): bicyclic nucleic acid (BNA)
uaaguucuguccaa

SEQ ID NO: 4299 - RNA, 13 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (13)..(13): bicyclic nucleic acid (BNA)
uaaguucugucca

SEQ ID NO: 4300 - RNA, 12 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (12)..(12): bicyclic nucleic acid (BNA)
uaaguucugucc

SEQ ID NO: 4301 - RNA, 11 nt, Artificial Sequence
  Description of Artificial Sequence: Synthetic Antisense oligonucleotide
  misc_feature (7)..(7): 5-methyl
  misc_feature (11)..(11): 5-methyl
  misc_feature (11)..(11): bicyclic nucleic acid (BNA)
uaaguucuguc

SEQ ID NO: 4302 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(7): 5-methyl
  misc_feature (10)..(10): bicyclic nucleic acid (BNA)
uaaguucugt

SEQ ID NO: 4303 - RNA, 9 nt, Artificial Sequence
  Description of Artificial Sequence: Synthetic Antisense oligonucleotide
  misc_feature (7)..(7): 5-methyl
  misc_feature (9)..(9): bicyclic nucleic acid (BNA)
uaaguucug

SEQ ID NO: 4304 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(7): 5-methyl
  misc_feature (8)..(8): bicyclic nucleic acid (BNA)
uaaguuct

SEQ ID NO: 4305 - RNA, 20 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(19): 5-methyl
  misc_feature (20)..(20): bicyclic nucleic acid (BNA)
guaaguucuguccaagcccg

SEQ ID NO: 4306 - RNA, 19 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(19): 5-methyl
  misc_feature (19)..(19): bicyclic nucleic acid (BNA)
guaaguucuguccaagccc

SEQ ID NO: 4307 - RNA, 17 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(17): 5-methyl
  misc_feature (17)..(17): bicyclic nucleic acid (BNA)
guaaguucuguccaagc

SEQ ID NO: 4308 - RNA, 16 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (16)..(16): bicyclic nucleic acid (BNA)
guaaguucuguccaag

SEQ ID NO: 4309 - RNA, 15 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (15)..(15): bicyclic nucleic acid (BNA)
guaaguucuguccaa

SEQ ID NO: 4310 - RNA, 14 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (14)..(14): bicyclic nucleic acid (BNA)
guaaguucugucca

SEQ ID NO: 4311 - RNA, 13 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (13)..(13): bicyclic nucleic acid (BNA)
guaaguucugucc

SEQ ID NO: 4312 - RNA, 12 nt, Artificial Sequence
  Description of Artificial Sequence: Synthetic Antisense oligonucleotide
  misc_feature (8)..(8): 5-methyl
  misc_feature (12)..(12): 5-methyl
  misc_feature (12)..(12): bicyclic nucleic acid (BNA)
guaaguucuguc

SEQ ID NO: 4313 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): 5-methyl
  misc_feature (11)..(11): bicyclic nucleic acid (BNA)
guaaguucugt

SEQ ID NO: 4314 - RNA, 10 nt, Artificial Sequence
  Description of Artificial Sequence: Synthetic Antisense oligonucleotide
  misc_feature (8)..(8): 5-methyl
  misc_feature (10)..(10): bicyclic nucleic acid (BNA)
guaaguucug

SEQ ID NO: 4315 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): 5-methyl
  misc_feature (9)..(9): bicyclic nucleic acid (BNA)
guaaguuct

SEQ ID NO: 4316 - RNA, 8 nt, Artificial Sequence
  Description of Artificial Sequence: Synthetic Antisense oligonucleotide
  misc_feature (8)..(8): 5-methyl
  misc_feature (8)..(8): bicyclic nucleic acid (BNA)
guaaguuc

SEQ ID NO: 4317 - RNA, 20 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(20): 5-methyl
  misc_feature (20)..(20): bicyclic nucleic acid (BNA)
gguaaguucuguccaagccc

SEQ ID NO: 4318 - RNA, 19 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(19): 5-methyl
  misc_feature (19)..(19): bicyclic nucleic acid (BNA)
gguaaguucuguccaagcc

SEQ ID NO: 4319 - RNA, 17 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (17)..(17): bicyclic nucleic acid (BNA)
gguaaguucuguccaag

SEQ ID NO: 4320 - RNA, 16 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (16)..(16): bicyclic nucleic acid (BNA)
gguaaguucuguccaa

SEQ ID NO: 4321 - RNA, 15 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (15)..(15): bicyclic nucleic acid (BNA)
gguaaguucugucca

SEQ ID NO: 4322 - RNA, 14 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (14)..(14): bicyclic nucleic acid (BNA)
gguaaguucugucc

SEQ ID NO: 4323 - RNA, 13 nt, Artificial Sequence
  Description of Artificial Sequence: Synthetic Antisense oligonucleotide
  misc_feature (9)..(9): 5-methyl
  misc_feature (13)..(13): 5-methyl
  misc_feature (13)..(13): bicyclic nucleic acid (BNA)
gguaaguucuguc

SEQ ID NO: 4324 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): 5-methyl
  misc_feature (12)..(12): bicyclic nucleic acid (BNA)
gguaaguucugt

SEQ ID NO: 4325 - RNA, 11 nt, Artificial Sequence
  Description of Artificial Sequence: Synthetic Antisense oligonucleotide
  misc_feature (9)..(9): 5-methyl
  misc_feature (11)..(11): bicyclic nucleic acid (BNA)
gguaaguucug

SEQ ID NO: 4326 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): 5-methyl
  misc_feature (10)..(10): bicyclic nucleic acid (BNA)
gguaaguuct

SEQ ID NO: 4327 - RNA, 9 nt, Artificial Sequence
  Description of Artificial Sequence: Synthetic Antisense oligonucleotide
  misc_feature (9)..(9): 5-methyl
  misc_feature (9)..(9): bicyclic nucleic acid (BNA)
gguaaguuc

SEQ ID NO: 4328 - RNA, 20 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(20): 5-methyl
  misc_feature (20)..(20): bicyclic nucleic acid (BNA)
cgguaaguucuguccaagcc

SEQ ID NO: 4329 - RNA, 19 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(19): 5-methyl
  misc_feature (19)..(19): bicyclic nucleic acid (BNA)
cgguaaguucuguccaagc

SEQ ID NO: 4330 - RNA, 18 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (18)..(18): bicyclic nucleic acid (BNA)
cgguaaguucuguccaag

SEQ ID NO: 4331 - RNA, 17 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (17)..(17): bicyclic nucleic acid (BNA)
cgguaaguucuguccaa

SEQ ID NO: 4332 - RNA, 16 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (16)..(16): bicyclic nucleic acid (BNA)
cgguaaguucugucca

SEQ ID NO: 4333 - RNA, 15 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (15)..(15): bicyclic nucleic acid (BNA)
cgguaaguucugucc

SEQ ID NO: 4334 - RNA, 14 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(14): 5-methyl
  misc_feature (14)..(14): bicyclic nucleic acid (BNA)
cgguaaguucuguc

SEQ ID NO: 4335 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (10)..(10): 5-methyl
  misc_feature (13)..(13): bicyclic nucleic acid (BNA)
cgguaaguucugt

SEQ ID NO: 4336 - RNA, 12 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (12)..(12): bicyclic nucleic acid (BNA)
cgguaaguucug

SEQ ID NO: 4337 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (10)..(10): 5-methyl
  misc_feature (11)..(11): bicyclic nucleic acid (BNA)
cgguaaguuct

SEQ ID NO: 4338 - RNA, 10 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (10)..(10): bicyclic nucleic acid (BNA)
cgguaaguuc

SEQ ID NO: 4339 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (9)..(9): bicyclic nucleic acid (BNA)
cgguaagut

SEQ ID NO: 4340 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (8)..(8): bicyclic nucleic acid (BNA)
cgguaagt

SEQ ID NO: 4341 - RNA, 20 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (20)..(20): 5-methyl
  misc_feature (20)..(20): bicyclic nucleic acid (BNA)
ucgguaaguucuguccaagc

SEQ ID NO: 4342 - RNA, 19 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (19)..(19): bicyclic nucleic acid (BNA)
ucgguaaguucuguccaag

SEQ ID NO: 4343 - RNA, 18 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (18)..(18): bicyclic nucleic acid (BNA)
ucgguaaguucuguccaa

SEQ ID NO: 4344 - RNA, 17 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (17)..(17): bicyclic nucleic acid (BNA)
ucgguaaguucugucca

SEQ ID NO: 4345 - RNA, 16 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (16)..(16): bicyclic nucleic acid (BNA)
ucgguaaguucugucc

SEQ ID NO: 4346 - RNA, 15 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(15): 5-methyl
  misc_feature (15)..(15): bicyclic nucleic acid (BNA)
ucgguaaguucuguc

SEQ ID NO: 4347 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (11)..(11): 5-methyl
  misc_feature (14)..(14): bicyclic nucleic acid (BNA)
ucgguaaguucugt

SEQ ID NO: 4348 - RNA, 13 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (13)..(13): bicyclic nucleic acid (BNA)
ucgguaaguucug

SEQ ID NO: 4349 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (11)..(11): 5-methyl
  misc_feature (12)..(12): bicyclic nucleic acid (BNA)
ucgguaaguuct

SEQ ID NO: 4350 - RNA, 11 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (11)..(11): bicyclic nucleic acid (BNA)
ucgguaaguuc

SEQ ID NO: 4351 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (10)..(10): bicyclic nucleic acid (BNA)
ucgguaagut

SEQ ID NO: 4352 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (9)..(9): bicyclic nucleic acid (BNA)
ucgguaagt

SEQ ID NO: 4353 - RNA, 20 nt, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
  misc_feature (20)..(20): bicyclic nucleic acid (BNA)
gucgguaaguucuguccaag

SEQ ID NO: 4354 - RNA, 19 nt, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
  misc_feature (19)..(19): bicyclic nucleic acid (BNA)
gucgguaaguucuguccaa

SEQ ID NO: 4355 - RNA, 18 nt, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
  misc_feature (18)..(18): bicyclic nucleic acid (BNA)
gucgguaaguucugucca

SEQ ID NO: 4356 - RNA, 17 nt, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
  misc_feature (17)..(17): bicyclic nucleic acid (BNA)
gucgguaaguucugucc

SEQ ID NO: 4357 - RNA, 16 nt, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(16): 5-methyl
  misc_feature (16)..(16): bicyclic nucleic acid (BNA)
gucgguaaguucuguc

SEQ ID NO: 4358 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (12)..(12): 5-methyl
  misc_feature (15)..(15): bicyclic nucleic acid (BNA)
gucgguaaguucugt

SEQ ID NO: 4359 - RNA, 14 nt, Artificial Sequence
  Description of Artificial Sequence: Synthetic Antisense oligonucleotide
  misc_feature (3)..(3): 5-methyl
  misc_feature (12)..(12): 5-methyl
  misc_feature (14)..(14): bicyclic nucleic acid (BNA)
gucgguaaguucug

SEQ ID NO: 4360 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (12)..(12): 5-methyl
  misc_feature (13)..(13): bicyclic nucleic acid (BNA)
gucgguaaguuct

SEQ ID NO: 4361 - RNA, 12 nt, Artificial Sequence
  Description of Artificial Sequence: Synthetic Antisense oligonucleotide
  misc_feature (3)..(3): 5-methyl
  misc_feature (12)..(12): 5-methyl
  misc_feature (12)..(12): bicyclic nucleic acid (BNA)
gucgguaaguuc

SEQ ID NO: 4362 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (11)..(11): bicyclic nucleic acid (BNA)
gucgguaagut

SEQ ID NO: 4363 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (10)..(10): bicyclic nucleic acid (BNA)
gucgguaagt

SEQ ID NO: 4364 - RNA, 20 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (20)..(20): bicyclic nucleic acid (BNA)
agucgguaaguucuguccaa

SEQ ID NO: 4365 - RNA, 19 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (19)..(19): bicyclic nucleic acid (BNA)
agucgguaaguucugucca

SEQ ID NO: 4366 - RNA, 17 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(17): 5-methyl
  misc_feature (17)..(17): bicyclic nucleic acid (BNA)
agucgguaaguucuguc

SEQ ID NO: 4367 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (4)..(4): 5-methyl
  misc_feature (13)..(13): 5-methyl
  misc_feature (16)..(16): bicyclic nucleic acid (BNA)
agucgguaaguucugt

SEQ ID NO: 4368 - RNA, 15 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (15)..(15): bicyclic nucleic acid (BNA)
agucgguaaguucug

SEQ ID NO: 4369 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (4)..(4): 5-methyl
  misc_feature (13)..(13): 5-methyl
  misc_feature (14)..(14): bicyclic nucleic acid (BNA)
agucgguaaguuct

SEQ ID NO: 4370 - RNA, 13 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (13)..(13): bicyclic nucleic acid (BNA)
agucgguaaguuc

SEQ ID NO: 4371 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (4)..(4): 5-methyl
  misc_feature (12)..(12): bicyclic nucleic acid (BNA)
agucgguaagut

SEQ ID NO: 4372 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (4)..(4): 5-methyl
  misc_feature (11)..(11): bicyclic nucleic acid (BNA)
agucgguaagt

SEQ ID NO: 4373 - RNA, 20 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (20)..(20): bicyclic nucleic acid (BNA)
cagucgguaaguucugucca

SEQ ID NO: 4374 - RNA, 19 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (19)..(19): bicyclic nucleic acid (BNA)
cagucgguaaguucugucc

SEQ ID NO: 4375 - RNA, 18 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(18): 5-methyl
  misc_feature (18)..(18): bicyclic nucleic acid (BNA)
cagucgguaaguucuguc

SEQ ID NO: 4376 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (14)..(14): 5-methyl
  misc_feature (17)..(17): bicyclic nucleic acid (BNA)
cagucgguaaguucugt

SEQ ID NO: 4377 - RNA, 16 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (16)..(16): bicyclic nucleic acid (BNA)
cagucgguaaguucug

SEQ ID NO: 4378 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (14)..(14): 5-methyl
  misc_feature (15)..(15): bicyclic nucleic acid (BNA)
cagucgguaaguuct

SEQ ID NO: 4379 - RNA, 14 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (14)..(14): bicyclic nucleic acid (BNA)
cagucgguaaguuc

SEQ ID NO: 4380 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (13)..(13): bicyclic nucleic acid (BNA)
cagucgguaagut

SEQ ID NO: 4381 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (12)..(12): bicyclic nucleic acid (BNA)
cagucgguaagt

SEQ ID NO: 4382 - RNA, 20 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(20): 5-methyl
  misc_feature (20)..(20): bicyclic nucleic acid (BNA)
ccagucgguaaguucugucc

SEQ ID NO: 4383 - RNA, 19 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(19): 5-methyl
  misc_feature (19)..(19): bicyclic nucleic acid (BNA)
ccagucgguaaguucuguc

SEQ ID NO: 4384 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (15)..(15): 5-methyl
  misc_feature (18)..(18): bicyclic nucleic acid (BNA)
ccagucgguaaguucugt

SEQ ID NO: 4385 - RNA, 17 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (17)..(17): bicyclic nucleic acid (BNA)
ccagucgguaaguucug

SEQ ID NO: 4386 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (15)..(15): 5-methyl
  misc_feature (16)..(16): bicyclic nucleic acid (BNA)
ccagucgguaaguuct

SEQ ID NO: 4387 - RNA, 15 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (15)..(15): bicyclic nucleic acid (BNA)
ccagucgguaaguuc

SEQ ID NO: 4388 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (14)..(14): bicyclic nucleic acid (BNA)
ccagucgguaagut

SEQ ID NO: 4389 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (13)..(13): bicyclic nucleic acid (BNA)
ccagucgguaagt

SEQ ID NO: 4390 - RNA, 20 nt, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
  misc_feature (20)..(20): 5-methyl
  misc_feature (20)..(20): bicyclic nucleic acid (BNA)
gccagucgguaaguucuguc

SEQ ID NO: 4391 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (7)..(7): 5-methyl
  misc_feature (16)..(16): 5-methyl
  misc_feature (19)..(19): bicyclic nucleic acid (BNA)
gccagucgguaaguucugt

SEQ ID NO: 4392 - RNA, 18 nt, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
  misc_feature (18)..(18): bicyclic nucleic acid (BNA)
gccagucgguaaguucug

SEQ ID NO: 4393 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (7)..(7): 5-methyl
  misc_feature (16)..(16): 5-methyl
  misc_feature (17)..(17): bicyclic nucleic acid (BNA)
gccagucgguaaguuct

SEQ ID NO: 4394 - RNA, 16 nt, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
  misc_feature (16)..(16): bicyclic nucleic acid (BNA)
gccagucgguaaguuc

SEQ ID NO: 4395 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (7)..(7): 5-methyl
  misc_feature (15)..(15): bicyclic nucleic acid (BNA)
gccagucgguaagut

SEQ ID NO: 4396 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (7)..(7): 5-methyl
  misc_feature (14)..(14): bicyclic nucleic acid (BNA)
gccagucgguaagt

SEQ ID NO: 4397 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (20)..(20): bicyclic nucleic acid (BNA)
ucaaggaagauggcauuuct

SEQ ID NO: 4398 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (22)..(22): bicyclic nucleic acid (BNA)
ucaaggaagauggcauuucuag

SEQ ID NO: 4399 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (16)..(16): bicyclic nucleic acid (BNA)
ucaaggaagauggcat

SEQ ID NO: 4400 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): 5-methyl
  misc_feature (14)..(14): 5-methyl
  misc_feature (15)..(15): bicyclic nucleic acid (BNA)
gaagauggcauuuct

SEQ ID NO: 4401 - RNA, 21 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (21)..(21): bicyclic nucleic acid (BNA)
ucaaggaagauggcauuucua

SEQ ID NO: 4402 - RNA, 19 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (19)..(19): bicyclic nucleic acid (BNA)
ucaaggaagauggcauuuc

SEQ ID NO: 4403 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (18)..(18): bicyclic nucleic acid (BNA)
ucaaggaagauggcauut

SEQ ID NO: 4404 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (17)..(17): bicyclic nucleic acid (BNA)
ucaaggaagauggcaut

SEQ ID NO: 4405 - RNA, 15 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (15)..(15): bicyclic nucleic acid (BNA)
ucaaggaagauggca

SEQ ID NO: 4406 - RNA, 14 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (14)..(14): bicyclic nucleic acid (BNA)
ucaaggaagauggc

SEQ ID NO: 4407 - RNA, 13 nt, Artificial Sequence
  Description of Artificial Sequence: Synthetic Antisense oligonucleotide
  misc_feature (2)..(2): 5-methyl
  misc_feature (13)..(13): bicyclic nucleic acid (BNA)
ucaaggaagaugg

SEQ ID NO: 4408 - RNA, 12 nt, Artificial Sequence
  Description of Artificial Sequence: Synthetic Antisense oligonucleotide
  misc_feature (2)..(2): 5-methyl
  misc_feature (12)..(12): bicyclic nucleic acid (BNA)
ucaaggaagaug

SEQ ID NO: 4409 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (11)..(11): bicyclic nucleic acid (BNA)
ucaaggaagat

SEQ ID NO: 4410 - RNA, 10 nt, Artificial Sequence
  Description of Artificial Sequence: Synthetic Antisense oligonucleotide
  misc_feature (2)..(2): 5-methyl
  misc_feature (10)..(10): bicyclic nucleic acid (BNA)
ucaaggaaga

SEQ ID NO: 4411 - RNA, 9 nt, Artificial Sequence
  Description of Artificial Sequence: Synthetic Antisense oligonucleotide
  misc_feature (2)..(2): 5-methyl
  misc_feature (9)..(9): bicyclic nucleic acid (BNA)
ucaaggaag

SEQ ID NO: 4412 - RNA, 21 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (21)..(21): bicyclic nucleic acid (BNA)
caaggaagauggcauuucuag

SEQ ID NO: 4413 - RNA, 20 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (20)..(20): bicyclic nucleic acid (BNA)
caaggaagauggcauuucua

SEQ ID NO: 4414 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (18)..(18): 5-methyl
  misc_feature (19)..(19): bicyclic nucleic acid (BNA)
caaggaagauggcauuuct

SEQ ID NO: 4415 - RNA, 18 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (18)..(18): bicyclic nucleic acid (BNA)
caaggaagauggcauuuc

SEQ ID NO: 4416 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (17)..(17): bicyclic nucleic acid (BNA)
caaggaagauggcauut

SEQ ID NO: 4417 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (16)..(16): bicyclic nucleic acid (BNA)
caaggaagauggcaut

SEQ ID NO: 4418 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (15)..(15): bicyclic nucleic acid (BNA)
caaggaagauggcat

SEQ ID NO: 4419 - RNA, 14 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (14)..(14): bicyclic nucleic acid (BNA)
caaggaagauggca

SEQ ID NO: 4420 - RNA, 13 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (13)..(13): bicyclic nucleic acid (BNA)
caaggaagauggc

SEQ ID NO: 4421 - RNA, 12 nt, Artificial Sequence
  Description of Artificial Sequence: Synthetic Antisense oligonucleotide
  misc_feature (1)..(1): 5-methyl
  misc_feature (12)..(12): bicyclic nucleic acid (BNA)
caaggaagaugg

SEQ ID NO: 4422 - RNA, 11 nt, Artificial Sequence
  Description of Artificial Sequence: Synthetic Antisense oligonucleotide
  misc_feature (1)..(1): 5-methyl
  misc_feature (11)..(11): bicyclic nucleic acid (BNA)
caaggaagaug

SEQ ID NO: 4423 - DNA, 10 bp, Artificial Sequence
  Description of Artificial Sequence: Synthetic Antisense oligonucleotide
  misc_feature (1)..(1): 5-methyl
  misc_feature (10)..(10): bicyclic nucleic acid (BNA)
caaggaagat

SEQ ID NO: 4424 - RNA, 9 nt, Artificial Sequence
  Description of Artificial Sequence: Synthetic Antisense oligonucleotide
  misc_feature (1)..(1): 5-methyl
  misc_feature (9)..(9): bicyclic nucleic acid (BNA)
caaggaaga

SEQ ID NO: 4425 - RNA, 8 nt, Artificial Sequence
  Description of Artificial Sequence: Synthetic Antisense oligonucleotide
  misc_feature (1)..(1): 5-methyl
  misc_feature (8)..(8): bicyclic nucleic acid (BNA)
caaggaag

SEQ ID NO: 4426 - RNA, 20 nt, Artificial Sequence
  Description of Artificial Sequence: Synthetic Antisense oligonucleotide
  misc_feature (12)..(12): 5-methyl
  misc_feature (17)..(17): 5-methyl
  misc_feature (20)..(20): bicyclic nucleic acid (BNA)
aaggaagauggcauuucuag

SEQ ID NO: 4427 - RNA, 19 nt, Artificial Sequence
  Description of Artificial Sequence: Synthetic Antisense oligonucleotide
  misc_feature (12)..(12): 5-methyl
  misc_feature (17)..(17): 5-methyl
  misc_feature (19)..(19): bicyclic nucleic acid (BNA)
aaggaagauggcauuucua

SEQ ID NO: 4428 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): 5-methyl
  misc_feature (17)..(17): 5-methyl
  misc_feature (18)..(18): bicyclic nucleic acid (BNA)
aaggaagauggcauuuct

SEQ ID NO: 4429 - RNA, 17 nt, Artificial Sequence
  Description of Artificial Sequence: Synthetic Antisense oligonucleotide
  misc_feature (12)..(12): 5-methyl
  misc_feature (17)..(17): 5-methyl
  misc_feature (17)..(17): bicyclic nucleic acid (BNA)
aaggaagauggcauuuc

SEQ ID NO: 4430 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): 5-methyl
  misc_feature (16)..(16): bicyclic nucleic acid (BNA)
aaggaagauggcauut

SEQ ID NO: 4431 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): 5-methyl
  misc_feature (15)..(15): bicyclic nucleic acid (BNA)
aaggaagauggcaut

SEQ ID NO: 4432 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): 5-methyl
  misc_feature (14)..(14): bicyclic nucleic acid (BNA)
aaggaagauggcat

SEQ ID NO: 4433 - RNA, 13 nt, Artificial Sequence
  Description of Artificial Sequence: Synthetic Antisense oligonucleotide
  misc_feature (12)..(12): 5-methyl
  misc_feature (13)..(13): bicyclic nucleic acid (BNA)
aaggaagauggca

SEQ ID NO: 4434 - RNA, 12 nt, Artificial Sequence
  Description of Artificial Sequence: Synthetic Antisense oligonucleotide
  misc_feature (12)..(12): 5-methyl
  misc_feature (12)..(12): bicyclic nucleic acid (BNA)
aaggaagauggc

SEQ ID NO: 4435 - RNA, 19 nt, Artificial Sequence
  Description of Artificial Sequence: Synthetic Antisense oligonucleotide
  misc_feature (11)..(11): 5-methyl
  misc_feature (16)..(16): 5-methyl
  misc_feature (19)..(19): bicyclic nucleic acid (BNA)
aggaagauggcauuucuag

SEQ ID NO: 4436 - RNA, 18 nt, Artificial Sequence
  Description of Artificial Sequence: Synthetic Antisense oligonucleotide
  misc_feature (11)..(11): 5-methyl
  misc_feature (16)..(16): 5-methyl
  misc_feature (18)..(18): bicyclic nucleic acid (BNA)
aggaagauggcauuucua

SEQ ID NO: 4437 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): 5-methyl
  misc_feature (16)..(16): 5-methyl
  misc_feature (17)..(17): bicyclic nucleic acid (BNA)
aggaagauggcauuuct

SEQ ID NO: 4438 - RNA, 16 nt, Artificial Sequence
  Description of Artificial Sequence: Synthetic Antisense oligonucleotide
  misc_feature (11)..(11): 5-methyl
  misc_feature (16)..(16): 5-methyl
  misc_feature (16)..(16): bicyclic nucleic acid (BNA)
aggaagauggcauuuc

SEQ ID NO: 4439 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): 5-methyl
  misc_feature (15)..(15): bicyclic nucleic acid (BNA)
aggaagauggcauut

SEQ ID NO: 4440 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): 5-methyl
  misc_feature (14)..(14): bicyclic nucleic acid (BNA)
aggaagauggcaut

SEQ ID NO: 4441 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): 5-methyl
  misc_feature (13)..(13): bicyclic nucleic acid (BNA)
aggaagauggcat

SEQ ID NO: 4442 - RNA, 12 nt, Artificial Sequence
  Description of Artificial Sequence: Synthetic Antisense oligonucleotide
  misc_feature (11)..(11): 5-methyl
  misc_feature (12)..(12): bicyclic nucleic acid (BNA)
aggaagauggca

SEQ ID NO: 4443 - RNA, 18 nt, Artificial Sequence
  Description of Artificial Sequence: Synthetic Antisense oligonucleotide
  misc_feature (10)..(10): 5-methyl
  misc_feature (15)..(15): 5-methyl
  misc_feature (18)..(18): bicyclic nucleic acid (BNA)
ggaagauggcauuucuag

SEQ ID NO: 4444 - RNA, 17 nt, Artificial Sequence
  Description of Artificial Sequence: Synthetic Antisense oligonucleotide
  misc_feature (10)..(10): 5-methyl
  misc_feature (15)..(15): 5-methyl
  misc_feature (17)..(17): bicyclic nucleic acid (BNA)
ggaagauggcauuucua

SEQ ID NO: 4445 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(10): 5-methyl
  misc_feature (15)..(15): 5-methyl
  misc_feature (16)..(16): bicyclic nucleic acid (BNA)
ggaagauggcauuuct

SEQ ID NO: 4446 - RNA, 15 nt, Artificial Sequence
  Description of Artificial Sequence: Synthetic Antisense oligonucleotide
  misc_feature (10)..(10): 5-methyl
  misc_feature (15)..(15): 5-methyl
  misc_feature (15)..(15): bicyclic nucleic acid (BNA)
ggaagauggcauuuc

SEQ ID NO: 4447 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(10): 5-methyl
  misc_feature (14)..(14): bicyclic nucleic acid (BNA)
ggaagauggcauut

SEQ ID NO: 4448 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(10): 5-methyl
  misc_feature (13)..(13): bicyclic nucleic acid (BNA)
ggaagauggcaut

SEQ ID NO: 4449 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(10): 5-methyl
  misc_feature (12)..(12): bicyclic nucleic acid (BNA)
ggaagauggcat

SEQ ID NO: 4450 - RNA, 11 nt, Artificial Sequence
  Description of Artificial Sequence: Synthetic Antisense oligonucleotide
  misc_feature (10)..(10): 5-methyl
  misc_feature (11)..(11): bicyclic nucleic acid (BNA)
ggaagauggca

SEQ ID NO: 4451 - RNA, 10 nt, Artificial Sequence
  Description of Artificial Sequence: Synthetic Antisense oligonucleotide
  misc_feature (10)..(10): 5-methyl
  misc_feature (10)..(10): bicyclic nucleic acid (BNA)
ggaagauggc

SEQ ID NO: 4452 - RNA, 17 nt, Artificial Sequence
  Description of Artificial Sequence: Synthetic Antisense oligonucleotide
  misc_feature (9)..(9): 5-methyl
  misc_feature (14)..(14): 5-methyl
  misc_feature (17)..(17): bicyclic nucleic acid (BNA)
gaagauggcauuucuag

SEQ ID NO: 4453 - RNA, 16 nt, Artificial Sequence
  Description of Artificial Sequence: Synthetic Antisense oligonucleotide
  misc_feature (9)..(9): 5-methyl
  misc_feature (14)..(14): 5-methyl
  misc_feature (16)..(16): bicyclic nucleic acid (BNA)
gaagauggcauuucua

SEQ ID NO: 4454 - RNA, 14 nt, Artificial Sequence
  Description of Artificial Sequence: Synthetic Antisense oligonucleotide
  misc_feature (9)..(9): 5-methyl
  misc_feature (14)..(14): 5-methyl
  misc_feature (14)..(14): bicyclic nucleic acid (BNA)
gaagauggcauuuc

SEQ ID NO: 4455 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): 5-methyl
  misc_feature (13)..(13): bicyclic nucleic acid (BNA)
gaagauggcauut

SEQ ID NO: 4456 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): 5-methyl
  misc_feature (12)..(12): bicyclic nucleic acid (BNA)
gaagauggcaut

SEQ ID NO: 4457 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): 5-methyl
  misc_feature (11)..(11): bicyclic nucleic acid (BNA)
gaagauggcat

SEQ ID NO: 4458 - RNA, 10 nt, Artificial Sequence
  Description of Artificial Sequence: Synthetic Antisense oligonucleotide
  misc_feature (9)..(9): 5-methyl
  misc_feature (10)..(10): bicyclic nucleic acid (BNA)
gaagauggca

SEQ ID NO: 4459 - RNA, 9 nt, Artificial Sequence
  Description of Artificial Sequence: Synthetic Antisense oligonucleotide
  misc_feature (9)..(9): 5-methyl
  misc_feature (9)..(9): bicyclic nucleic acid (BNA)
gaagauggc

SEQ ID NO: 4460 - RNA, 16 nt, Artificial Sequence
  Description of Artificial Sequence: Synthetic Antisense oligonucleotide
  misc_feature (8)..(8): 5-methyl
  misc_feature (13)..(13): 5-methyl
  misc_feature (16)..(16): bicyclic nucleic acid (BNA)
aagauggcauuucuag

SEQ ID NO: 4461 - RNA, 15 nt, Artificial Sequence
  Description of Artificial Sequence: Synthetic Antisense oligonucleotide
  misc_feature (8)..(8): 5-methyl
  misc_feature (13)..(13): 5-methyl
  misc_feature (15)..(15): bicyclic nucleic acid (BNA)
aagauggcauuucua

SEQ ID NO: 4462 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): 5-methyl
  misc_feature (13)..(13): 5-methyl
  misc_feature (14)..(14): bicyclic nucleic acid (BNA)
aagauggcauuuct

SEQ ID NO: 4463 - RNA, 13 nt, Artificial Sequence
  Description of Artificial Sequence: Synthetic Antisense oligonucleotide
  misc_feature (8)..(8): 5-methyl
  misc_feature (13)..(13): 5-methyl
  misc_feature (13)..(13): bicyclic nucleic acid (BNA)
aagauggcauuuc

SEQ ID NO: 4464 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): 5-methyl
  misc_feature (12)..(12): bicyclic nucleic acid (BNA)
aagauggcauut

SEQ ID NO: 4465 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): 5-methyl
  misc_feature (11)..(11): bicyclic nucleic acid (BNA)
aagauggcaut

SEQ ID NO: 4466 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): 5-methyl
  misc_feature (10)..(10): bicyclic nucleic acid (BNA)
aagauggcat

SEQ ID NO: 4467 - RNA, 9 nt, Artificial Sequence
  Description of Artificial Sequence: Synthetic Antisense oligonucleotide
  misc_feature (8)..(8): 5-methyl
  misc_feature (9)..(9): bicyclic nucleic acid (BNA)
aagauggca

SEQ ID NO: 4468 - RNA, 8 nt, Artificial Sequence
  Description of Artificial Sequence: Synthetic Antisense oligonucleotide
  misc_feature (8)..(8): 5-methyl
  misc_feature (8)..(8): bicyclic nucleic acid (BNA)
aagauggc

SEQ ID NO: 4469 - RNA, 15 nt, Artificial Sequence
  Description of Artificial Sequence: Synthetic Antisense oligonucleotide
  misc_feature (7)..(7): 5-methyl
  misc_feature (12)..(12): 5-methyl
  misc_feature (15)..(15): bicyclic nucleic acid (BNA)
agauggcauuucuag

SEQ ID NO: 4470 - RNA, 14 nt, Artificial Sequence
  Description of Artificial Sequence: Synthetic Antisense oligonucleotide
  misc_feature (7)..(7): 5-methyl
  misc_feature (12)..(12): 5-methyl
  misc_feature (14)..(14): bicyclic nucleic acid (BNA)
agauggcauuucua

SEQ ID NO: 4471 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(7): 5-methyl
  misc_feature (12)..(12): 5-methyl
  misc_feature (13)..(13): bicyclic nucleic acid (BNA)
agauggcauuuct

SEQ ID NO: 4472 - RNA, 12 nt, Artificial Sequence
  Description of Artificial Sequence: Synthetic Antisense oligonucleotide
  misc_feature (7)..(7): 5-methyl
  misc_feature (12)..(12): 5-methyl
  misc_feature (12)..(12): bicyclic nucleic acid (BNA)
agauggcauuuc

SEQ ID NO: 4473 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(7): 5-methyl
  misc_feature (11)..(11): bicyclic nucleic acid (BNA)
agauggcauut

SEQ ID NO: 4474 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(7): 5-methyl
  misc_feature (10)..(10): bicyclic nucleic acid (BNA)
agauggcaut

SEQ ID NO: 4475 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(7): 5-methyl
  misc_feature (9)..(9): bicyclic nucleic acid (BNA)
agauggcat

SEQ ID NO: 4476 - RNA, 8 nt, Artificial Sequence
  Description of Artificial Sequence: Synthetic Antisense oligonucleotide
  misc_feature (7)..(7): 5-methyl
  misc_feature (8)..(8): bicyclic nucleic acid (BNA)
agauggca

SEQ ID NO: 4477 - RNA, 30 nt, Artificial Sequence; identical to SEQ ID NO: 287
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (30)..(30): bicyclic nucleic acid (BNA)

SEQ ID NO: 4478 - RNA, 29 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (29)..(29): bicyclic nucleic acid (BNA)
cuccaacaucaaggaagauggcauuucua

SEQ ID NO: 4479 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (28)..(28): bicyclic nucleic acid (BNA)
cuccaacaucaaggaagauggcauuuct

SEQ ID NO: 4480 - RNA, 27 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (27)..(27): bicyclic nucleic acid (BNA)
cuccaacaucaaggaagauggcauuuc

SEQ ID NO: 4481 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (26)..(26): bicyclic nucleic acid (BNA)
cuccaacaucaaggaagauggcauut

SEQ ID NO: 4482 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (25)..(25): bicyclic nucleic acid (BNA)
cuccaacaucaaggaagauggcaut

SEQ ID NO: 4483 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (24)..(24): bicyclic nucleic acid (BNA)
cuccaacaucaaggaagauggcat

SEQ ID NO: 4484 - RNA, 23 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (23)..(23): bicyclic nucleic acid (BNA)
cuccaacaucaaggaagauggca

SEQ ID NO: 4485 - RNA, 22 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (22)..(22): bicyclic nucleic acid (BNA)
cuccaacaucaaggaagauggc

SEQ ID NO: 4486 - RNA, 21 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (21)..(21): bicyclic nucleic acid (BNA)
cuccaacaucaaggaagaugg

SEQ ID NO: 4487 - RNA, 20 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (20)..(20): bicyclic nucleic acid (BNA)
cuccaacaucaaggaagaug

SEQ ID NO: 4488 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (19)..(19): bicyclic nucleic acid (BNA)
cuccaacaucaaggaagat

SEQ ID NO: 4489 - RNA, 18 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (18)..(18): bicyclic nucleic acid (BNA)
cuccaacaucaaggaaga

SEQ ID NO: 4490 - RNA, 17 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (17)..(17): bicyclic nucleic acid (BNA)
cuccaacaucaaggaag

SEQ ID NO: 4491 - RNA, 29 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
  misc_feature (29)..(29): bicyclic nucleic acid (BNA)
uccaacaucaaggaagauggcauuucuag

SEQ ID NO: 4492 - RNA, 28 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
  misc_feature (28)..(28): bicyclic nucleic acid (BNA)
uccaacaucaaggaagauggcauuucua

SEQ ID NO: 4493 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
  misc_feature (27)..(27): bicyclic nucleic acid (BNA)
uccaacaucaaggaagauggcauuuct

SEQ ID NO: 4494 - RNA, 26 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
  misc_feature (26)..(26): bicyclic nucleic acid (BNA)
uccaacaucaaggaagauggcauuuc

SEQ ID NO: 4495 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (25)..(25): bicyclic nucleic acid (BNA)
uccaacaucaaggaagauggcauut

SEQ ID NO: 4496 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (24)..(24): bicyclic nucleic acid (BNA)
uccaacaucaaggaagauggcaut

SEQ ID NO: 4497 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (23)..(23): bicyclic nucleic acid (BNA)
uccaacaucaaggaagauggcat

SEQ ID NO: 4498 - RNA, 22 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (22)..(22): bicyclic nucleic acid (BNA)
uccaacaucaaggaagauggca

SEQ ID NO: 4499 - RNA, 21 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (21)..(21): bicyclic nucleic acid (BNA)
uccaacaucaaggaagauggc

SEQ ID NO: 4500 - RNA, 20 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (20)..(20): bicyclic nucleic acid (BNA)
uccaacaucaaggaagaugg

SEQ ID NO: 4501 - RNA, 19 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (19)..(19): bicyclic nucleic acid (BNA)
uccaacaucaaggaagaug

SEQ ID NO: 4502 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (6)..(6): 5-methyl
  misc_feature (9)..(9): 5-methyl
  misc_feature (18)..(18): bicyclic nucleic acid (BNA)
uccaacaucaaggaagat

SEQ ID NO: 4503 - RNA, 17 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (17)..(17): bicyclic nucleic acid (BNA)
uccaacaucaaggaaga

SEQ ID NO: 4504 - RNA, 16 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (16)..(16): bicyclic nucleic acid (BNA)
uccaacaucaaggaag

SEQ ID NO: 4505 - RNA, 28 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (28)..(28): bicyclic nucleic acid (BNA)
ccaacaucaaggaagauggcauuucuag

SEQ ID NO: 4506 - RNA, 27 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (27)..(27): bicyclic nucleic acid (BNA)
ccaacaucaaggaagauggcauuucua

SEQ ID NO: 4507 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (26)..(26): bicyclic nucleic acid (BNA)
ccaacaucaaggaagauggcauuuct

SEQ ID NO: 4508 - RNA, 25 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (25)..(25): bicyclic nucleic acid (BNA)
ccaacaucaaggaagauggcauuuc

SEQ ID NO: 4509 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (24)..(24): bicyclic nucleic acid (BNA)
ccaacaucaaggaagauggcauut

SEQ ID NO: 4510 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (23)..(23): bicyclic nucleic acid (BNA)
ccaacaucaaggaagauggcaut

SEQ ID NO: 4511 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (22)..(22): bicyclic nucleic acid (BNA)
ccaacaucaaggaagauggcat

SEQ ID NO: 4512 - RNA, 21 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (21)..(21): bicyclic nucleic acid (BNA)
ccaacaucaaggaagauggca

SEQ ID NO: 4513 - RNA, 20 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (20)..(20): bicyclic nucleic acid (BNA)
ccaacaucaaggaagauggc

SEQ ID NO: 4514 - RNA, 19 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (19)..(19): bicyclic nucleic acid (BNA)
ccaacaucaaggaagaugg

SEQ ID NO: 4515 - RNA, 18 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (18)..(18): bicyclic nucleic acid (BNA)
ccaacaucaaggaagaug

SEQ ID NO: 4516 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (17)..(17): bicyclic nucleic acid (BNA)
ccaacaucaaggaagat

SEQ ID NO: 4517 - RNA, 16 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (16)..(16): bicyclic nucleic acid (BNA)
ccaacaucaaggaaga

SEQ ID NO: 4518 - RNA, 15 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (15)..(15): bicyclic nucleic acid (BNA)
ccaacaucaaggaag

SEQ ID NO: 4519 - RNA, 27 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (27)..(27): bicyclic nucleic acid (BNA)
caacaucaaggaagauggcauuucuag

SEQ ID NO: 4520 - RNA, 26 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (26)..(26): bicyclic nucleic acid (BNA)
caacaucaaggaagauggcauuucua

SEQ ID NO: 4521 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (25)..(25): bicyclic nucleic acid (BNA)
caacaucaaggaagauggcauuuct

SEQ ID NO: 4522 - RNA, 24 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (24)..(24): bicyclic nucleic acid (BNA)
caacaucaaggaagauggcauuuc

SEQ ID NO: 4523 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (23)..(23): bicyclic nucleic acid (BNA)
caacaucaaggaagauggcauut

SEQ ID NO: 4524 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (22)..(22): bicyclic nucleic acid (BNA)
caacaucaaggaagauggcaut

SEQ ID NO: 4525 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (21)..(21): bicyclic nucleic acid (BNA)
caacaucaaggaagauggcat

SEQ ID NO: 4526 - RNA, 20 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (20)..(20): bicyclic nucleic acid (BNA)
caacaucaaggaagauggca

SEQ ID NO: 4527 - RNA, 19 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (19)..(19): bicyclic nucleic acid (BNA)
caacaucaaggaagauggc

SEQ ID NO: 4528 - RNA, 18 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (18)..(18): bicyclic nucleic acid (BNA)
caacaucaaggaagaugg

SEQ ID NO: 4529 - RNA, 17 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (17)..(17): bicyclic nucleic acid (BNA)
caacaucaaggaagaug

SEQ ID NO: 4530 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (16)..(16): bicyclic nucleic acid (BNA)
caacaucaaggaagat

SEQ ID NO: 4531 - RNA, 15 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (15)..(15): bicyclic nucleic acid (BNA)
caacaucaaggaaga

SEQ ID NO: 4532 - RNA, 14 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (14)..(14): bicyclic nucleic acid (BNA)
caacaucaaggaag

SEQ ID NO: 4533 - RNA, 26 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
  misc_feature (26)..(26): bicyclic nucleic acid (BNA)
aacaucaaggaagauggcauuucuag

SEQ ID NO: 4534 - RNA, 25 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
  misc_feature (25)..(25): bicyclic nucleic acid (BNA)
aacaucaaggaagauggcauuucua

SEQ ID NO: 4535 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
  misc_feature (24)..(24): bicyclic nucleic acid (BNA)
aacaucaaggaagauggcauuuct

SEQ ID NO: 4536 - RNA, 23 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
  misc_feature (23)..(23): bicyclic nucleic acid (BNA)
aacaucaaggaagauggcauuuc

SEQ ID NO: 4537 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (6)..(6): 5-methyl
  misc_feature (18)..(18): 5-methyl
  misc_feature (22)..(22): bicyclic nucleic acid (BNA)
aacaucaaggaagauggcauut

SEQ ID NO: 4538 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (6)..(6): 5-methyl
  misc_feature (18)..(18): 5-methyl
  misc_feature (21)..(21): bicyclic nucleic acid (BNA)
aacaucaaggaagauggcaut

SEQ ID NO: 4539 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (6)..(6): 5-methyl
  misc_feature (18)..(18): 5-methyl
  misc_feature (20)..(20): bicyclic nucleic acid (BNA)
aacaucaaggaagauggcat

SEQ ID NO: 4540 - RNA, 19 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (19)..(19): bicyclic nucleic acid (BNA)
aacaucaaggaagauggca

SEQ ID NO: 4541 - RNA, 18 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (18)..(18): bicyclic nucleic acid (BNA)
aacaucaaggaagauggc

SEQ ID NO: 4542 - RNA, 17 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (17)..(17): bicyclic nucleic acid (BNA)
aacaucaaggaagaugg

SEQ ID NO: 4543 - RNA, 16 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (16)..(16): bicyclic nucleic acid (BNA)
aacaucaaggaagaug

SEQ ID NO: 4544 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (6)..(6): 5-methyl
  misc_feature (15)..(15): bicyclic nucleic acid (BNA)
aacaucaaggaagat

SEQ ID NO: 4545 - RNA, 14 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (14)..(14): bicyclic nucleic acid (BNA)
aacaucaaggaaga

SEQ ID NO: 4546 - RNA, 13 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (13)..(13): bicyclic nucleic acid (BNA)
aacaucaaggaag

SEQ ID NO: 4547 - RNA, 25 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
  misc_feature (25)..(25): bicyclic nucleic acid (BNA)
acaucaaggaagauggcauuucuag

SEQ ID NO: 4548 - RNA, 24 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
  misc_feature (24)..(24): bicyclic nucleic acid (BNA)
acaucaaggaagauggcauuucua

SEQ ID NO: 4549 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
  misc_feature (23)..(23): bicyclic nucleic acid (BNA)
acaucaaggaagauggcauuuct

SEQ ID NO: 4550 - RNA, 22 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
  misc_feature (22)..(22): bicyclic nucleic acid (BNA)
acaucaaggaagauggcauuuc

SEQ ID NO: 4551 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (5)..(5): 5-methyl
  misc_feature (17)..(17): 5-methyl
  misc_feature (21)..(21): bicyclic nucleic acid (BNA)
acaucaaggaagauggcauut

SEQ ID NO: 4552 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (5)..(5): 5-methyl
  misc_feature (17)..(17): 5-methyl
  misc_feature (20)..(20): bicyclic nucleic acid (BNA)
acaucaaggaagauggcaut

SEQ ID NO: 4553 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (5)..(5): 5-methyl
  misc_feature (17)..(17): 5-methyl
  misc_feature (19)..(19): bicyclic nucleic acid (BNA)
acaucaaggaagauggcat

SEQ ID NO: 4554 - RNA, 18 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (18)..(18): bicyclic nucleic acid (BNA)
acaucaaggaagauggca

SEQ ID NO: 4555 - RNA, 17 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (17)..(17): bicyclic nucleic acid (BNA)
acaucaaggaagauggc

SEQ ID NO: 4556 - RNA, 16 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (16)..(16): bicyclic nucleic acid (BNA)
acaucaaggaagaugg

SEQ ID NO: 4557 - RNA, 15 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (15)..(15): bicyclic nucleic acid (BNA)
acaucaaggaagaug

SEQ ID NO: 4558 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (5)..(5): 5-methyl
  misc_feature (14)..(14): bicyclic nucleic acid (BNA)
acaucaaggaagat

SEQ ID NO: 4559 - RNA, 13 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (13)..(13): bicyclic nucleic acid (BNA)
acaucaaggaaga

SEQ ID NO: 4560 - RNA, 12 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (12)..(12): bicyclic nucleic acid (BNA)
acaucaaggaag

SEQ ID NO: 4561 - RNA, 24 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (24)..(24): bicyclic nucleic acid (BNA)
caucaaggaagauggcauuucuag

SEQ ID NO: 4562 - RNA, 23 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (23)..(23): bicyclic nucleic acid (BNA)
caucaaggaagauggcauuucua

SEQ ID NO: 4563 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (22)..(22): bicyclic nucleic acid (BNA)
caucaaggaagauggcauuuct

SEQ ID NO: 4564 - RNA, 21 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (21)..(21): bicyclic nucleic acid (BNA)
caucaaggaagauggcauuuc

SEQ ID NO: 4565 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (20)..(20): bicyclic nucleic acid (BNA)
caucaaggaagauggcauut

SEQ ID NO: 4566 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (19)..(19): bicyclic nucleic acid (BNA)
caucaaggaagauggcaut

SEQ ID NO: 4567 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (18)..(18): bicyclic nucleic acid (BNA)
caucaaggaagauggcat

SEQ ID NO: 4568 - RNA, 17 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (17)..(17): bicyclic nucleic acid (BNA)
caucaaggaagauggca

SEQ ID NO: 4569 - RNA, 16 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (16)..(16): bicyclic nucleic acid (BNA)
caucaaggaagauggc

SEQ ID NO: 4570 - RNA, 15 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (15)..(15): bicyclic nucleic acid (BNA)
caucaaggaagaugg

SEQ ID NO: 4571 - RNA, 14 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (14)..(14): bicyclic nucleic acid (BNA)
caucaaggaagaug

SEQ ID NO: 4572 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (13)..(13): bicyclic nucleic acid (BNA)
caucaaggaagat

SEQ ID NO: 4573 - RNA, 12 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (12)..(12): bicyclic nucleic acid (BNA)
caucaaggaaga

SEQ ID NO: 4574 - RNA, 11 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (11)..(11): bicyclic nucleic acid (BNA)
caucaaggaag

SEQ ID NO: 4575 - RNA, 23 nt, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
  misc_feature (23)..(23): bicyclic nucleic acid (BNA)
aucaaggaagauggcauuucuag

SEQ ID NO: 4576 - RNA, 22 nt, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
  misc_feature (22)..(22): bicyclic nucleic acid (BNA)
aucaaggaagauggcauuucua

SEQ ID NO: 4577 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (15)..(15): 5-methyl
  misc_feature (20)..(20): 5-methyl
  misc_feature (21)..(21): bicyclic nucleic acid (BNA)
aucaaggaagauggcauuuct

SEQ ID NO: 4578 - RNA, 20 nt, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
  misc_feature (20)..(20): bicyclic nucleic acid (BNA)
aucaaggaagauggcauuuc

SEQ ID NO: 4579 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (15)..(15): 5-methyl
  misc_feature (19)..(19): bicyclic nucleic acid (BNA)
aucaaggaagauggcauut

SEQ ID NO: 4580 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (15)..(15): 5-methyl
  misc_feature (18)..(18): bicyclic nucleic acid (BNA)
aucaaggaagauggcaut

SEQ ID NO: 4581 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (15)..(15): 5-methyl
  misc_feature (17)..(17): bicyclic nucleic acid (BNA)
aucaaggaagauggcat

SEQ ID NO: 4582 - RNA, 16 nt, Artificial Sequence
  Description of Artificial Sequence: Synthetic Antisense oligonucleotide
  misc_feature (3)..(3): 5-methyl
  misc_feature (15)..(15): 5-methyl
  misc_feature (16)..(16): bicyclic nucleic acid (BNA)
aucaaggaagauggca

SEQ ID NO: 4583 - RNA, 15 nt, Artificial Sequence
  Description of Artificial Sequence: Synthetic Antisense oligonucleotide
  misc_feature (3)..(3): 5-methyl
  misc_feature (15)..(15): 5-methyl
  misc_feature (15)..(15): bicyclic nucleic acid (BNA)
aucaaggaagauggc

SEQ ID NO: 4584 - RNA, 14 nt, Artificial Sequence
  Description of Artificial Sequence: Synthetic Antisense oligonucleotide
  misc_feature (3)..(3): 5-methyl
  misc_feature (14)..(14): bicyclic nucleic acid (BNA)
aucaaggaagaugg

SEQ ID NO: 4585 - RNA, 13 nt, Artificial Sequence
  Description of Artificial Sequence: Synthetic Antisense oligonucleotide
  misc_feature (3)..(3): 5-methyl
  misc_feature (13)..(13): bicyclic nucleic acid (BNA)
aucaaggaagaug

SEQ ID NO: 4586 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (12)..(12): bicyclic nucleic acid (BNA)
aucaaggaagat

SEQ ID NO: 4587 - RNA, 11 nt, Artificial Sequence
  Description of Artificial Sequence: Synthetic Antisense oligonucleotide
  misc_feature (3)..(3): 5-methyl
  misc_feature (11)..(11): bicyclic nucleic acid (BNA)
aucaaggaaga

SEQ ID NO: 4588 - RNA, 10 nt, Artificial Sequence
  Description of Artificial Sequence: Synthetic Antisense oligonucleotide
  misc_feature (3)..(3): 5-methyl
  misc_feature (10)..(10): bicyclic nucleic acid (BNA)
aucaaggaag

SEQ ID NO: 4589 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 4590 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 4591 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 4592 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (18)..(18): bicyclic nucleic acid (BNA)
cuguccaagcccgguuga

SEQ ID NO: 4593 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
  misc_feature (7)..(7): 5-methyl
  misc_feature (11)..(12): 5-methyl
taaguucuguccaag

SEQ ID NO: 4594 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
  misc_feature (3)..(3): 5-methyl
  misc_feature (7)..(8): 5-methyl
  misc_feature (12)..(14): 5-methyl
tucuguccaagcccgguuga

SEQ ID NO: 4595 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
  misc_feature (3)..(3): 5-methyl
  misc_feature (7)..(8): 5-methyl
  misc_feature (12)..(14): 5-methyl
tucuguccaagcccgguug

SEQ ID NO: 4596 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
  misc_feature (3)..(3): 5-methyl
  misc_feature (7)..(8): 5-methyl
  misc_feature (12)..(14): 5-methyl
tucuguccaagcccggut

SEQ ID NO: 4597 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
  misc_feature (3)..(3): 5-methyl
  misc_feature (7)..(8): 5-methyl
  misc_feature (12)..(14): 5-methyl
tucuguccaagcccggt

SEQ ID NO: 4598 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
  misc_feature (3)..(3): 5-methyl
  misc_feature (7)..(8): 5-methyl
  misc_feature (12)..(14): 5-methyl
tucuguccaagcccgg

SEQ ID NO: 4599 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
  misc_feature (3)..(3): 5-methyl
  misc_feature (7)..(8): 5-methyl
  misc_feature (12)..(14): 5-methyl
tucuguccaagcccg

SEQ ID NO: 4600 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (3)..(3): 5-methyl
  misc_feature (7)..(8): 5-methyl
  misc_feature (12)..(14): 5-methyl
tucuguccaagccc

SEQ ID NO: 4601 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (3)..(3): 5-methyl
  misc_feature (7)..(8): 5-methyl
  misc_feature (12)..(13): 5-methyl
tucuguccaagcc

SEQ ID NO: 4602 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (3)..(3): 5-methyl
  misc_feature (7)..(8): 5-methyl
  misc_feature (12)..(12): 5-methyl
tucuguccaagc

SEQ ID NO: 4603 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
  misc_feature (3)..(3): 5-methyl
  misc_feature (7)..(8): 5-methyl
tucuguccaag

SEQ ID NO: 4604 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (10)..(10): bicyclic nucleic acid (BNA)
  misc_feature (3)..(3): 5-methyl
  misc_feature (7)..(8): 5-methyl
tucuguccaa

SEQ ID NO: 4605 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (3)..(3): 5-methyl
  misc_feature (7)..(8): 5-methyl
tucugucca

SEQ ID NO: 4606 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (8)..(8): bicyclic nucleic acid (BNA)
  misc_feature (3)..(3): 5-methyl
  misc_feature (7)..(8): 5-methyl
tucugucc

SEQ ID NO: 4607 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
  misc_feature (2)..(2): 5-methyl
  misc_feature (6)..(7): 5-methyl
  misc_feature (11)..(13): 5-methyl
tcuguccaagcccgguuga

SEQ ID NO: 4608 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
  misc_feature (2)..(2): 5-methyl
  misc_feature (6)..(7): 5-methyl
  misc_feature (11)..(13): 5-methyl
tcuguccaagcccgguug

SEQ ID NO: 4609 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
  misc_feature (2)..(2): 5-methyl
  misc_feature (6)..(7): 5-methyl
  misc_feature (11)..(13): 5-methyl
tcuguccaagcccggut

SEQ ID NO: 4610 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
  misc_feature (2)..(2): 5-methyl
  misc_feature (6)..(7): 5-methyl
  misc_feature (11)..(13): 5-methyl
tcuguccaagcccggt

SEQ ID NO: 4611 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
  misc_feature (2)..(2): 5-methyl
  misc_feature (6)..(7): 5-methyl
  misc_feature (11)..(13): 5-methyl
tcuguccaagcccgg

SEQ ID NO: 4612 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (2)..(2): 5-methyl
  misc_feature (6)..(7): 5-methyl
  misc_feature (11)..(13): 5-methyl
tcuguccaagcccg

SEQ ID NO: 4613 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (2)..(2): 5-methyl
  misc_feature (6)..(7): 5-methyl
  misc_feature (11)..(13): 5-methyl
tcuguccaagccc

SEQ ID NO: 4614 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (2)..(2): 5-methyl
  misc_feature (6)..(7): 5-methyl
  misc_feature (11)..(12): 5-methyl
tcuguccaagcc

SEQ ID NO: 4615 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
  misc_feature (2)..(2): 5-methyl
  misc_feature (6)..(7): 5-methyl
  misc_feature (11)..(11): 5-methyl
tcuguccaagc

SEQ ID NO: 4616 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (10)..(10): bicyclic nucleic acid (BNA)
  misc_feature (2)..(2): 5-methyl
  misc_feature (6)..(7): 5-methyl
tcuguccaag

SEQ ID NO: 4617 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (2)..(2): 5-methyl
  misc_feature (6)..(7): 5-methyl
tcuguccaa

SEQ ID NO: 4618 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (8)..(8): bicyclic nucleic acid (BNA)
  misc_feature (2)..(2): 5-methyl
  misc_feature (6)..(7): 5-methyl
tcugucca

SEQ ID NO: 4619 - RNA, 17 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (17)..(17): bicyclic nucleic acid (BNA)
cuguccaagcccgguug

SEQ ID NO: 4620 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (16)..(16): bicyclic nucleic acid (BNA)
cuguccaagcccggut

SEQ ID NO: 4621 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (15)..(15): bicyclic nucleic acid (BNA)
cuguccaagcccggt

SEQ ID NO: 4622 - RNA, 14 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (14)..(14): bicyclic nucleic acid (BNA)
cuguccaagcccgg

SEQ ID NO: 4623 - RNA, 13 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(13): bicyclic nucleic acid (BNA)
cuguccaagcccg

SEQ ID NO: 4624 - RNA, 12 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(12): bicyclic nucleic acid (BNA)
cuguccaagccc

SEQ ID NO: 4625 - RNA, 11 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(11): 5-methyl
  misc_feature (1)..(1): bicyclic nucleic acid (BNA)
  misc_feature (11)..(11): bicyclic nucleic acid (BNA)
cuguccaagcc

SEQ ID NO: 4626 - RNA, 10 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(10): 5-methyl
  misc_feature (1)..(1): bicyclic nucleic acid (BNA)
  misc_feature (10)..(10): bicyclic nucleic acid (BNA)
cuguccaagc

SEQ ID NO: 4627 - RNA, 9 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (1)..(1): bicyclic nucleic acid (BNA)
  misc_feature (9)..(9): bicyclic nucleic acid (BNA)
cuguccaag

SEQ ID NO: 4628 - RNA, 8 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (1)..(1): bicyclic nucleic acid (BNA)
  misc_feature (8)..(8): bicyclic nucleic acid (BNA)
cuguccaa

SEQ ID NO: 4629 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (4)..(4): 5-methyl
  misc_feature (8)..(9): 5-methyl
  misc_feature (13)..(15): 5-methyl
guucuguccaagcccgguug

SEQ ID NO: 4630 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
  misc_feature (4)..(4): 5-methyl
  misc_feature (8)..(9): 5-methyl
  misc_feature (13)..(15): 5-methyl
guucuguccaagcccggut

SEQ ID NO: 4631 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
  misc_feature (4)..(4): 5-methyl
  misc_feature (8)..(9): 5-methyl
  misc_feature (13)..(15): 5-methyl
guucuguccaagcccggt

SEQ ID NO: 4632 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (4)..(4): 5-methyl
  misc_feature (8)..(9): 5-methyl
  misc_feature (13)..(15): 5-methyl
guucuguccaagcccgg

SEQ ID NO: 4633 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (4)..(4): 5-methyl
  misc_feature (8)..(9): 5-methyl
  misc_feature (13)..(15): 5-methyl
guucuguccaagcccg

SEQ ID NO: 4634 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (4)..(4): 5-methyl
  misc_feature (8)..(9): 5-methyl
  misc_feature (13)..(15): 5-methyl
guucuguccaagccc

SEQ ID NO: 4635 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (4)..(4): 5-methyl
  misc_feature (8)..(9): 5-methyl
  misc_feature (13)..(14): 5-methyl
guucuguccaagcc

SEQ ID NO: 4636 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (4)..(4): 5-methyl
  misc_feature (8)..(9): 5-methyl
  misc_feature (13)..(13): 5-methyl
guucuguccaagc

SEQ ID NO: 4637 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (4)..(4): 5-methyl
  misc_feature (8)..(9): 5-methyl
guucuguccaag

SEQ ID NO: 4638 - RNA, 11 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (4)..(4): 5-methyl
  misc_feature (8)..(9): 5-methyl
guucuguccaa

SEQ ID NO: 4639 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (4)..(4): 5-methyl
  misc_feature (8)..(9): 5-methyl
guucugucca

SEQ ID NO: 4640 - RNA, 9 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (4)..(4): 5-methyl
  misc_feature (8)..(9): 5-methyl
guucugucc

SEQ ID NO: 4641 - RNA, 8 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (4)..(4): 5-methyl
  misc_feature (8)..(8): 5-methyl
guucuguc

SEQ ID NO: 4642 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
  misc_feature (5)..(5): 5-methyl
  misc_feature (9)..(10): 5-methyl
  misc_feature (14)..(16): 5-methyl
aguucuguccaagcccggut

SEQ ID NO: 4643 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
  misc_feature (5)..(5): 5-methyl
  misc_feature (9)..(10): 5-methyl
  misc_feature (14)..(16): 5-methyl
aguucuguccaagcccggt

SEQ ID NO: 4644 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (5)..(5): 5-methyl
  misc_feature (9)..(10): 5-methyl
  misc_feature (14)..(16): 5-methyl
aguucuguccaagcccgg

SEQ ID NO: 4645 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (5)..(5): 5-methyl
  misc_feature (9)..(10): 5-methyl
  misc_feature (14)..(16): 5-methyl
aguucuguccaagcccg

SEQ ID NO: 4646 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (5)..(5): 5-methyl
  misc_feature (9)..(10): 5-methyl
  misc_feature (14)..(16): 5-methyl
aguucuguccaagccc

SEQ ID NO: 4647 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (5)..(5): 5-methyl
  misc_feature (9)..(10): 5-methyl
  misc_feature (14)..(15): 5-methyl
aguucuguccaagcc

SEQ ID NO: 4648 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (5)..(5): 5-methyl
  misc_feature (9)..(10): 5-methyl
  misc_feature (14)..(14): 5-methyl
aguucuguccaagc

SEQ ID NO: 4649 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (5)..(5): 5-methyl
  misc_feature (9)..(10): 5-methyl
aguucuguccaag

SEQ ID NO: 4650 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (5)..(5): 5-methyl
  misc_feature (9)..(10): 5-methyl
aguucuguccaa

SEQ ID NO: 4651 - RNA, 11 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (5)..(5): 5-methyl
  misc_feature (9)..(10): 5-methyl
aguucugucca

SEQ ID NO: 4652 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (5)..(5): 5-methyl
  misc_feature (9)..(10): 5-methyl
aguucugucc

SEQ ID NO: 4653 - RNA, 9 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (5)..(5): 5-methyl
  misc_feature (9)..(9): 5-methyl
aguucuguc

SEQ ID NO: 4654 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (8)..(8): bicyclic nucleic acid (BNA)
  misc_feature (5)..(5): 5-methyl
aguucugt

SEQ ID NO: 4655 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
  misc_feature (6)..(6): 5-methyl
  misc_feature (10)..(11): 5-methyl
  misc_feature (15)..(17): 5-methyl
aaguucuguccaagcccggt

SEQ ID NO: 4656 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (6)..(6): 5-methyl
  misc_feature (10)..(11): 5-methyl
  misc_feature (15)..(17): 5-methyl
aaguucuguccaagcccgg

SEQ ID NO: 4657 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (6)..(6): 5-methyl
  misc_feature (10)..(11): 5-methyl
  misc_feature (15)..(17): 5-methyl
aaguucuguccaagcccg

SEQ ID NO: 4658 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (6)..(6): 5-methyl
  misc_feature (10)..(11): 5-methyl
  misc_feature (15)..(17): 5-methyl
aaguucuguccaagccc

SEQ ID NO: 4659 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (6)..(6): 5-methyl
  misc_feature (10)..(11): 5-methyl
  misc_feature (15)..(16): 5-methyl
aaguucuguccaagcc

SEQ ID NO: 4660 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (6)..(6): 5-methyl
  misc_feature (10)..(11): 5-methyl
  misc_feature (15)..(15): 5-methyl
aaguucuguccaagc

SEQ ID NO: 4661 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (6)..(6): 5-methyl
  misc_feature (10)..(11): 5-methyl
aaguucuguccaag

SEQ ID NO: 4662 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (6)..(6): 5-methyl
  misc_feature (10)..(11): 5-methyl
aaguucuguccaa

SEQ ID NO: 4663 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (6)..(6): 5-methyl
  misc_feature (10)..(11): 5-methyl
aaguucugucca

SEQ ID NO: 4664 - RNA, 11 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (6)..(6): 5-methyl
  misc_feature (10)..(11): 5-methyl
aaguucugucc

SEQ ID NO: 4665 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (6)..(6): 5-methyl
  misc_feature (10)..(10): 5-methyl
aaguucuguc

SEQ ID NO: 4666 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (6)..(6): 5-methyl
aaguucugt

SEQ ID NO: 4667 - RNA, 8 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (6)..(6): 5-methyl
aaguucug

SEQ ID NO: 4668 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
  misc_feature (7)..(7): 5-methyl
  misc_feature (11)..(12): 5-methyl
  misc_feature (16)..(18): 5-methyl
taaguucuguccaagcccgg

SEQ ID NO: 4669 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
  misc_feature (7)..(7): 5-methyl
  misc_feature (11)..(12): 5-methyl
  misc_feature (16)..(18): 5-methyl
taaguucuguccaagcccg

SEQ ID NO: 4670 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
  misc_feature (7)..(7): 5-methyl
  misc_feature (11)..(12): 5-methyl
  misc_feature (16)..(18): 5-methyl
taaguucuguccaagccc

SEQ ID NO: 4671 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
  misc_feature (7)..(7): 5-methyl
  misc_feature (11)..(12): 5-methyl
  misc_feature (16)..(17): 5-methyl
taaguucuguccaagcc

SEQ ID NO: 4672 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
  misc_feature (7)..(7): 5-methyl
  misc_feature (11)..(12): 5-methyl
  misc_feature (16)..(16): 5-methyl
taaguucuguccaagc

SEQ ID NO: 4673 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (7)..(7): 5-methyl
  misc_feature (11)..(12): 5-methyl
taaguucuguccaa

SEQ ID NO: 4674 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (7)..(7): 5-methyl
  misc_feature (11)..(12): 5-methyl
taaguucugucca

SEQ ID NO: 4675 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (7)..(7): 5-methyl
  misc_feature (11)..(12): 5-methyl
taaguucugucc

SEQ ID NO: 4676 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
  misc_feature (7)..(7): 5-methyl
  misc_feature (11)..(11): 5-methyl
taaguucuguc

SEQ ID NO: 4677 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (10)..(10): bicyclic nucleic acid (BNA)
  misc_feature (7)..(7): 5-methyl
taaguucugt

SEQ ID NO: 4678 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (7)..(7): 5-methyl
taaguucug

SEQ ID NO: 4679 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (8)..(8): bicyclic nucleic acid (BNA)
  misc_feature (7)..(7): 5-methyl
taaguuct

SEQ ID NO: 4680 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (8)..(8): 5-methyl
  misc_feature (12)..(13): 5-methyl
  misc_feature (17)..(19): 5-methyl
guaaguucuguccaagcccg

SEQ ID NO: 4681 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (8)..(8): 5-methyl
  misc_feature (12)..(13): 5-methyl
  misc_feature (17)..(19): 5-methyl
guaaguucuguccaagccc

SEQ ID NO: 4682 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(17): 5-methyl
guaaguucuguccaagc

SEQ ID NO: 4683 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (8)..(8): 5-methyl
  misc_feature (12)..(13): 5-methyl
guaaguucuguccaag

SEQ ID NO: 4684 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (8)..(8): 5-methyl
  misc_feature (12)..(13): 5-methyl
guaaguucuguccaa

SEQ ID NO: 4685 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (8)..(8): 5-methyl
  misc_feature (12)..(13): 5-methyl
guaaguucugucca

SEQ ID NO: 4686 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (8)..(8): 5-methyl
  misc_feature (12)..(13): 5-methyl
guaaguucugucc

SEQ ID NO: 4687 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (8)..(8): 5-methyl
  misc_feature (12)..(12): 5-methyl
guaaguucuguc

SEQ ID NO: 4688 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
  misc_feature (8)..(8): 5-methyl
guaaguucugt

SEQ ID NO: 4689 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (8)..(8): 5-methyl
guaaguucug

SEQ ID NO: 4690 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (8)..(8): 5-methyl
guaaguuct

SEQ ID NO: 4691 - RNA, 8 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (8)..(8): 5-methyl
guaaguuc

SEQ ID NO: 4692 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (9)..(9): 5-methyl
  misc_feature (13)..(14): 5-methyl
  misc_feature (18)..(20): 5-methyl
gguaaguucuguccaagccc

SEQ ID NO: 4693 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (9)..(9): 5-methyl
  misc_feature (13)..(14): 5-methyl
  misc_feature (18)..(19): 5-methyl
gguaaguucuguccaagcc

SEQ ID NO: 4694 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (9)..(9): 5-methyl
  misc_feature (13)..(14): 5-methyl
gguaaguucuguccaag

SEQ ID NO: 4695 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (9)..(9): 5-methyl
  misc_feature (13)..(14): 5-methyl
gguaaguucuguccaa

SEQ ID NO: 4696 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (9)..(9): 5-methyl
  misc_feature (13)..(14): 5-methyl
gguaaguucugucca

SEQ ID NO: 4697 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (9)..(9): 5-methyl
  misc_feature (13)..(14): 5-methyl
gguaaguucugucc

SEQ ID NO: 4698 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (9)..(9): 5-methyl
  misc_feature (13)..(13): 5-methyl
gguaaguucuguc

SEQ ID NO: 4699 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (9)..(9): 5-methyl
gguaaguucugt

SEQ ID NO: 4700 - RNA, 11 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (9)..(9): 5-methyl
gguaaguucug

SEQ ID NO: 4701 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (10)..(10): bicyclic nucleic acid (BNA)
  misc_feature (9)..(9): 5-methyl
gguaaguuct

SEQ ID NO: 4702 - RNA, 9 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (9)..(9): 5-methyl
gguaaguuc

SEQ ID NO: 4703 - RNA, 20 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(20): 5-methyl
  misc_feature (1)..(1): bicyclic nucleic acid (BNA)
  misc_feature (20)..(20): bicyclic nucleic acid (BNA)
cgguaaguucuguccaagcc

SEQ ID NO: 4704 - RNA, 19 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(19): 5-methyl
  misc_feature (1)..(1): bicyclic nucleic acid (BNA)
  misc_feature (19)..(19): bicyclic nucleic acid (BNA)
cgguaaguucuguccaagc

SEQ ID NO: 4705 - RNA, 18 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(1): bicyclic nucleic acid (BNA)
  misc_feature (18)..(18): bicyclic nucleic acid (BNA)
cgguaaguucuguccaag

SEQ ID NO: 4706 - RNA, 17 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(1): bicyclic nucleic acid (BNA)
  misc_feature (17)..(17): bicyclic nucleic acid (BNA)
cgguaaguucuguccaa

SEQ ID NO: 4707 - RNA, 16 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(1): bicyclic nucleic acid (BNA)
  misc_feature (16)..(16): bicyclic nucleic acid (BNA)
cgguaaguucugucca

SEQ ID NO: 4708 - RNA, 15 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(1): bicyclic nucleic acid (BNA)
  misc_feature (15)..(15): bicyclic nucleic acid (BNA)
cgguaaguucugucc

SEQ ID NO: 4709 - RNA, 14 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(14): 5-methyl
  misc_feature (1)..(1): bicyclic nucleic acid (BNA)
  misc_feature (14)..(14): bicyclic nucleic acid (BNA)
cgguaaguucuguc

SEQ ID NO: 4710 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (10)..(10): 5-methyl
  misc_feature (1)..(1): bicyclic nucleic acid (BNA)
  misc_feature (13)..(13): bicyclic nucleic acid (BNA)
cgguaaguucugt

SEQ ID NO: 4711 - RNA, 12 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(1): bicyclic nucleic acid (BNA)
  misc_feature (12)..(12): bicyclic nucleic acid (BNA)
cgguaaguucug

SEQ ID NO: 4712 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (10)..(10): 5-methyl
  misc_feature (1)..(1): bicyclic nucleic acid (BNA)
  misc_feature (11)..(11): bicyclic nucleic acid (BNA)
cgguaaguuct

SEQ ID NO: 4713 - RNA, 10 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(1): bicyclic nucleic acid (BNA)
  misc_feature (10)..(10): bicyclic nucleic acid (BNA)
cgguaaguuc

SEQ ID NO: 4714 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (1)..(1): bicyclic nucleic acid (BNA)
  misc_feature (9)..(9): bicyclic nucleic acid (BNA)
cgguaagut

SEQ ID NO: 4715 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (1)..(1): bicyclic nucleic acid (BNA)
  misc_feature (8)..(8): bicyclic nucleic acid (BNA)
cgguaagt

SEQ ID NO: 4716 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
  misc_feature (2)..(2): 5-methyl
  misc_feature (11)..(11): 5-methyl
  misc_feature (15)..(16): 5-methyl
  misc_feature (20)..(20): 5-methyl
tcgguaaguucuguccaagc

SEQ ID NO: 4717 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
  misc_feature (2)..(2): 5-methyl
  misc_feature (11)..(11): 5-methyl
  misc_feature (15)..(16): 5-methyl
tcgguaaguucuguccaag

SEQ ID NO: 4718 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
  misc_feature (2)..(2): 5-methyl
  misc_feature (11)..(11): 5-methyl
  misc_feature (15)..(16): 5-methyl
tcgguaaguucuguccaa

SEQ ID NO: 4719 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
  misc_feature (2)..(2): 5-methyl
  misc_feature (11)..(11): 5-methyl
  misc_feature (15)..(16): 5-methyl
tcgguaaguucugucca

SEQ ID NO: 4720 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
  misc_feature (2)..(2): 5-methyl
  misc_feature (11)..(11): 5-methyl
  misc_feature (15)..(16): 5-methyl
tcgguaaguucugucc

SEQ ID NO: 4721 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
  misc_feature (2)..(2): 5-methyl
  misc_feature (11)..(11): 5-methyl
  misc_feature (15)..(15): 5-methyl
tcgguaaguucuguc

SEQ ID NO: 4722 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (2)..(2): 5-methyl
  misc_feature (11)..(11): 5-methyl
tcgguaaguucugt

SEQ ID NO: 4723 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (2)..(2): 5-methyl
  misc_feature (11)..(11): 5-methyl
tcgguaaguucug

SEQ ID NO: 4724 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (2)..(2): 5-methyl
  misc_feature (11)..(11): 5-methyl
tcgguaaguuct

SEQ ID NO: 4725 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
  misc_feature (2)..(2): 5-methyl
  misc_feature (11)..(11): 5-methyl
tcgguaaguuc

SEQ ID NO: 4726 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (10)..(10): bicyclic nucleic acid (BNA)
  misc_feature (2)..(2): 5-methyl
tcgguaagut

SEQ ID NO: 4727 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (2)..(2): 5-methyl
tcgguaagt

SEQ ID NO: 4728 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (3)..(3): 5-methyl
  misc_feature (12)..(12): 5-methyl
  misc_feature (16)..(17): 5-methyl
gucgguaaguucuguccaag

SEQ ID NO: 4729 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (3)..(3): 5-methyl
  misc_feature (12)..(12): 5-methyl
  misc_feature (16)..(17): 5-methyl
gucgguaaguucuguccaa

SEQ ID NO: 4730 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (3)..(3): 5-methyl
  misc_feature (12)..(12): 5-methyl
  misc_feature (16)..(17): 5-methyl
gucgguaaguucugucca

SEQ ID NO: 4731 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (3)..(3): 5-methyl
  misc_feature (12)..(12): 5-methyl
  misc_feature (16)..(17): 5-methyl
gucgguaaguucugucc

SEQ ID NO: 4732 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (3)..(3): 5-methyl
  misc_feature (12)..(12): 5-methyl
  misc_feature (16)..(16): 5-methyl
gucgguaaguucuguc

SEQ ID NO: 4733 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
  misc_feature (3)..(3): 5-methyl
  misc_feature (12)..(12): 5-methyl
gucgguaaguucugt

SEQ ID NO: 4734 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (3)..(3): 5-methyl
  misc_feature (12)..(12): 5-methyl
gucgguaaguucug

SEQ ID NO: 4735 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (3)..(3): 5-methyl
  misc_feature (12)..(12): 5-methyl
gucgguaaguuct

SEQ ID NO: 4736 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (3)..(3): 5-methyl
  misc_feature (12)..(12): 5-methyl
gucgguaaguuc

SEQ ID NO: 4737 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
  misc_feature (3)..(3): 5-methyl
gucgguaagut

SEQ ID NO: 4738 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (10)..(10): bicyclic nucleic acid (BNA)
  misc_feature (3)..(3): 5-methyl
gucgguaagt

SEQ ID NO: 4739 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (4)..(4): 5-methyl
  misc_feature (13)..(13): 5-methyl
  misc_feature (17)..(18): 5-methyl
agucgguaaguucuguccaa

SEQ ID NO: 4740 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (4)..(4): 5-methyl
  misc_feature (13)..(13): 5-methyl
  misc_feature (17)..(18): 5-methyl
agucgguaaguucugucca

SEQ ID NO: 4741 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(17): 5-methyl
agucgguaaguucuguc

SEQ ID NO: 4742 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
  misc_feature (4)..(4): 5-methyl
  misc_feature (13)..(13): 5-methyl
agucgguaaguucugt

SEQ ID NO: 4743 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (4)..(4): 5-methyl
  misc_feature (13)..(13): 5-methyl
agucgguaaguucug

SEQ ID NO: 4744 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (4)..(4): 5-methyl
  misc_feature (13)..(13): 5-methyl
agucgguaaguuct

SEQ ID NO: 4745 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (4)..(4): 5-methyl
  misc_feature (13)..(13): 5-methyl
agucgguaaguuc

SEQ ID NO: 4746 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (4)..(4): 5-methyl
agucgguaagut

SEQ ID NO: 4747 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
  misc_feature (4)..(4): 5-methyl
agucgguaagt

SEQ ID NO: 4748 - RNA, 20 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (1)..(1): bicyclic nucleic acid (BNA)
  misc_feature (20)..(20): bicyclic nucleic acid (BNA)
cagucgguaaguucugucca

SEQ ID NO: 4749 - RNA, 19 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (1)..(1): bicyclic nucleic acid (BNA)
  misc_feature (19)..(19): bicyclic nucleic acid (BNA)
cagucgguaaguucugucc

SEQ ID NO: 4750 - RNA, 18 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(18): 5-methyl
  misc_feature (1)..(1): bicyclic nucleic acid (BNA)
  misc_feature (18)..(18): bicyclic nucleic acid (BNA)
cagucgguaaguucuguc

SEQ ID NO: 4751 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (14)..(14): 5-methyl
  misc_feature (1)..(1): bicyclic nucleic acid (BNA)
  misc_feature (17)..(17): bicyclic nucleic acid (BNA)
cagucgguaaguucugt

SEQ ID NO: 4752 - RNA, 16 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(1): bicyclic nucleic acid (BNA)
  misc_feature (16)..(16): bicyclic nucleic acid (BNA)
cagucgguaaguucug

SEQ ID NO: 4753 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (14)..(14): 5-methyl
  misc_feature (1)..(1): bicyclic nucleic acid (BNA)
  misc_feature (15)..(15): bicyclic nucleic acid (BNA)
cagucgguaaguuct

SEQ ID NO: 4754 - RNA, 14 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(1): bicyclic nucleic acid (BNA)
  misc_feature (14)..(14): bicyclic nucleic acid (BNA)
cagucgguaaguuc

SEQ ID NO: 4755 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (1)..(1): bicyclic nucleic acid (BNA)
  misc_feature (13)..(13): bicyclic nucleic acid (BNA)
cagucgguaagut

SEQ ID NO: 4756 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (1)..(1): bicyclic nucleic acid (BNA)
  misc_feature (12)..(12): bicyclic nucleic acid (BNA)
cagucgguaagt

SEQ ID NO: 4757 - RNA, 20 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(20): 5-methyl
  misc_feature (1)..(1): bicyclic nucleic acid (BNA)
  misc_feature (20)..(20): bicyclic nucleic acid (BNA)
ccagucgguaaguucugucc

SEQ ID NO: 4758 - RNA, 19 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(19): 5-methyl
  misc_feature (1)..(1): bicyclic nucleic acid (BNA)
  misc_feature (19)..(19): bicyclic nucleic acid (BNA)
ccagucgguaaguucuguc

SEQ ID NO: 4759 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (15)..(15): 5-methyl
  misc_feature (1)..(1): bicyclic nucleic acid (BNA)
  misc_feature (18)..(18): bicyclic nucleic acid (BNA)
ccagucgguaaguucugt

SEQ ID NO: 4760 - RNA, 17 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(1): bicyclic nucleic acid (BNA)
  misc_feature (17)..(17): bicyclic nucleic acid (BNA)
ccagucgguaaguucug

SEQ ID NO: 4761 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (15)..(15): 5-methyl
  misc_feature (1)..(1): bicyclic nucleic acid (BNA)
  misc_feature (16)..(16): bicyclic nucleic acid (BNA)
ccagucgguaaguuct

SEQ ID NO: 4762 - RNA, 15 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(1): bicyclic nucleic acid (BNA)
  misc_feature (15)..(15): bicyclic nucleic acid (BNA)
ccagucgguaaguuc

SEQ ID NO: 4763 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (1)..(1): bicyclic nucleic acid (BNA)
  misc_feature (14)..(14): bicyclic nucleic acid (BNA)
ccagucgguaagut

SEQ ID NO: 4764 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (1)..(1): bicyclic nucleic acid (BNA)
  misc_feature (13)..(13): bicyclic nucleic acid (BNA)
ccagucgguaagt

SEQ ID NO: 4765 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (2)..(3): 5-methyl
  misc_feature (7)..(7): 5-methyl
  misc_feature (16)..(16): 5-methyl
  misc_feature (20)..(20): 5-methyl
gccagucgguaaguucuguc

SEQ ID NO: 4766 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
  misc_feature (2)..(3): 5-methyl
  misc_feature (7)..(7): 5-methyl
  misc_feature (16)..(16): 5-methyl
gccagucgguaaguucugt

SEQ ID NO: 4767 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (2)..(3): 5-methyl
  misc_feature (7)..(7): 5-methyl
  misc_feature (16)..(16): 5-methyl
gccagucgguaaguucug

SEQ ID NO: 4768 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
  misc_feature (2)..(3): 5-methyl
  misc_feature (7)..(7): 5-methyl
  misc_feature (16)..(16): 5-methyl
gccagucgguaaguuct

SEQ ID NO: 4769 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (2)..(3): 5-methyl
  misc_feature (7)..(7): 5-methyl
  misc_feature (16)..(16): 5-methyl
gccagucgguaaguuc

SEQ ID NO: 4770 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
  misc_feature (2)..(3): 5-methyl
  misc_feature (7)..(7): 5-methyl
gccagucgguaagut

SEQ ID NO: 4771 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (2)..(3): 5-methyl
  misc_feature (7)..(7): 5-methyl
gccagucgguaagt

SEQ ID NO: 4772 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 4773 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 4774 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
  misc_feature (2)..(2): 5-methyl
  misc_feature (14)..(14): 5-methyl
tcaaggaagauggcat

SEQ ID NO: 4775 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
  misc_feature (9)..(9): 5-methyl
  misc_feature (14)..(14): 5-methyl
gaagauggcauuuct

SEQ ID NO: 4776 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (21)..(21): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucua

SEQ ID NO: 4777 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuc

SEQ ID NO: 4778 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
  misc_feature (2)..(2): 5-methyl
  misc_feature (14)..(14): 5-methyl
tcaaggaagauggcauut

SEQ ID NO: 4779 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
  misc_feature (2)..(2): 5-methyl
  misc_feature (14)..(14): 5-methyl
tcaaggaagauggcaut

SEQ ID NO: 4780 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
  misc_feature (2)..(2): 5-methyl
  misc_feature (14)..(14): 5-methyl
tcaaggaagauggca

SEQ ID NO: 4781 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (2)..(2): 5-methyl
  misc_feature (14)..(14): 5-methyl
tcaaggaagauggc

SEQ ID NO: 4782 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (2)..(2): 5-methyl
tcaaggaagaugg

SEQ ID NO: 4783 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (2)..(2): 5-methyl
tcaaggaagaug

SEQ ID NO: 4784 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (2)..(2): 5-methyl
tcaaggaagat

SEQ ID NO: 4785 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (2)..(2): 5-methyl
tcaaggaaga

SEQ ID NO: 4786 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (2)..(2): 5-methyl
tcaaggaag

SEQ ID NO: 4787 - RNA, 21 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(1): bicyclic nucleic acid (BNA)
  misc_feature (21)..(21): bicyclic nucleic acid (BNA)
caaggaagauggcauuucuag

SEQ ID NO: 4788 - RNA, 20 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(1): bicyclic nucleic acid (BNA)
  misc_feature (20)..(20): bicyclic nucleic acid (BNA)
caaggaagauggcauuucua

SEQ ID NO: 4789 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (18)..(18): 5-methyl
  misc_feature (1)..(1): bicyclic nucleic acid (BNA)
  misc_feature (19)..(19): bicyclic nucleic acid (BNA)
caaggaagauggcauuuct

SEQ ID NO: 4790 - RNA, 18 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(1): bicyclic nucleic acid (BNA)
  misc_feature (18)..(18): bicyclic nucleic acid (BNA)
caaggaagauggcauuuc

SEQ ID NO: 4791 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (1)..(1): bicyclic nucleic acid (BNA)
  misc_feature (17)..(17): bicyclic nucleic acid (BNA)
caaggaagauggcauut

SEQ ID NO: 4792 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (1)..(1): bicyclic nucleic acid (BNA)
  misc_feature (16)..(16): bicyclic nucleic acid (BNA)
caaggaagauggcaut

SEQ ID NO: 4793 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (1)..(1): bicyclic nucleic acid (BNA)
  misc_feature (15)..(15): bicyclic nucleic acid (BNA)
caaggaagauggcat

SEQ ID NO: 4794 - RNA, 14 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(1): bicyclic nucleic acid (BNA)
  misc_feature (14)..(14): bicyclic nucleic acid (BNA)
caaggaagauggca

SEQ ID NO: 4795 - RNA, 13 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(1): bicyclic nucleic acid (BNA)
  misc_feature (13)..(13): bicyclic nucleic acid (BNA)
caaggaagauggc

SEQ ID NO: 4796 - RNA, 12 nt, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
  misc_feature (12)..(12): bicyclic nucleic acid (BNA)
caaggaagaugg

SEQ ID NO: 4797 - RNA, 11 nt, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
  misc_feature (11)..(11): bicyclic nucleic acid (BNA)
caaggaagaug

SEQ ID NO: 4798 - DNA, 10 bp, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
  misc_feature (10)..(10): bicyclic nucleic acid (BNA)
caaggaagat

SEQ ID NO: 4799 - RNA, 9 nt, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
  misc_feature (9)..(9): bicyclic nucleic acid (BNA)
caaggaaga

SEQ ID NO: 4800 - RNA, 8 nt, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
  misc_feature (8)..(8): bicyclic nucleic acid (BNA)
caaggaag

SEQ ID NO: 4801 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (12)..(12): 5-methyl
  misc_feature (17)..(17): 5-methyl
aaggaagauggcauuucuag

SEQ ID NO: 4802 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (12)..(12): 5-methyl
  misc_feature (17)..(17): 5-methyl
aaggaagauggcauuucua

SEQ ID NO: 4803 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
  misc_feature (12)..(12): 5-methyl
  misc_feature (17)..(17): 5-methyl
aaggaagauggcauuuct

SEQ ID NO: 4804 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (12)..(12): 5-methyl
  misc_feature (17)..(17): 5-methyl
aaggaagauggcauuuc

SEQ ID NO: 4805 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
  misc_feature (12)..(12): 5-methyl
aaggaagauggcauut

SEQ ID NO: 4806 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
  misc_feature (12)..(12): 5-methyl
aaggaagauggcaut

SEQ ID NO: 4807 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (12)..(12): 5-methyl
aaggaagauggcat

SEQ ID NO: 4808 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (12)..(12): 5-methyl
aaggaagauggca

SEQ ID NO: 4809 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (12)..(12): 5-methyl
aaggaagauggc

SEQ ID NO: 4810 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (11)..(11): 5-methyl
  misc_feature (16)..(16): 5-methyl
aggaagauggcauuucuag

SEQ ID NO: 4811 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (11)..(11): 5-methyl
  misc_feature (16)..(16): 5-methyl
aggaagauggcauuucua

SEQ ID NO: 4812 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
  misc_feature (11)..(11): 5-methyl
  misc_feature (16)..(16): 5-methyl
aggaagauggcauuuct

SEQ ID NO: 4813 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (11)..(11): 5-methyl
  misc_feature (16)..(16): 5-methyl
aggaagauggcauuuc

SEQ ID NO: 4814 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
  misc_feature (11)..(11): 5-methyl
aggaagauggcauut

SEQ ID NO: 4815 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (11)..(11): 5-methyl
aggaagauggcaut

SEQ ID NO: 4816 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (11)..(11): 5-methyl
aggaagauggcat

SEQ ID NO: 4817 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (11)..(11): 5-methyl
aggaagauggca

SEQ ID NO: 4818 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (10)..(10): 5-methyl
  misc_feature (15)..(15): 5-methyl
ggaagauggcauuucuag

SEQ ID NO: 4819 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (10)..(10): 5-methyl
  misc_feature (15)..(15): 5-methyl
ggaagauggcauuucua

SEQ ID NO: 4820 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
  misc_feature (10)..(10): 5-methyl
  misc_feature (15)..(15): 5-methyl
ggaagauggcauuuct

SEQ ID NO: 4821 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (10)..(10): 5-methyl
  misc_feature (15)..(15): 5-methyl
ggaagauggcauuuc

SEQ ID NO: 4822 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (10)..(10): 5-methyl
ggaagauggcauut

SEQ ID NO: 4823 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (10)..(10): 5-methyl
ggaagauggcaut

SEQ ID NO: 4824 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (10)..(10): 5-methyl
ggaagauggcat

SEQ ID NO: 4825 - RNA, 11 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (10)..(10): 5-methyl
ggaagauggca

SEQ ID NO: 4826 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (10)..(10): 5-methyl
ggaagauggc

SEQ ID NO: 4827 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (9)..(9): 5-methyl
  misc_feature (14)..(14): 5-methyl
gaagauggcauuucuag

SEQ ID NO: 4828 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (9)..(9): 5-methyl
  misc_feature (14)..(14): 5-methyl
gaagauggcauuucua

SEQ ID NO: 4829 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (9)..(9): 5-methyl
  misc_feature (14)..(14): 5-methyl
gaagauggcauuuc

SEQ ID NO: 4830 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (9)..(9): 5-methyl
gaagauggcauut

SEQ ID NO: 4831 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (9)..(9): 5-methyl
gaagauggcaut

SEQ ID NO: 4832 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
  misc_feature (9)..(9): 5-methyl
gaagauggcat

SEQ ID NO: 4833 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (9)..(9): 5-methyl
gaagauggca

SEQ ID NO: 4834 - RNA, 9 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (9)..(9): 5-methyl
gaagauggc

SEQ ID NO: 4835 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (8)..(8): 5-methyl
  misc_feature (13)..(13): 5-methyl
aagauggcauuucuag

SEQ ID NO: 4836 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (8)..(8): 5-methyl
  misc_feature (13)..(13): 5-methyl
aagauggcauuucua

SEQ ID NO: 4837 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (8)..(8): 5-methyl
  misc_feature (13)..(13): 5-methyl
aagauggcauuuct

SEQ ID NO: 4838 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (8)..(8): 5-methyl
  misc_feature (13)..(13): 5-methyl
aagauggcauuuc

SEQ ID NO: 4839 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (8)..(8): 5-methyl
aagauggcauut

SEQ ID NO: 4840 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
  misc_feature (8)..(8): 5-methyl
aagauggcaut

SEQ ID NO: 4841 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (10)..(10): bicyclic nucleic acid (BNA)
  misc_feature (8)..(8): 5-methyl
aagauggcat

SEQ ID NO: 4842 - RNA, 9 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (8)..(8): 5-methyl
aagauggca

SEQ ID NO: 4843 - RNA, 8 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (8)..(8): 5-methyl
aagauggc

SEQ ID NO: 4844 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (7)..(7): 5-methyl
  misc_feature (12)..(12): 5-methyl
agauggcauuucuag

SEQ ID NO: 4845 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (7)..(7): 5-methyl
  misc_feature (12)..(12): 5-methyl
agauggcauuucua

SEQ ID NO: 4846 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (7)..(7): 5-methyl
  misc_feature (12)..(12): 5-methyl
agauggcauuuct

SEQ ID NO: 4847 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (7)..(7): 5-methyl
  misc_feature (12)..(12): 5-methyl
agauggcauuuc

SEQ ID NO: 4848 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (11)..(11): bicyclic nucleic acid (BNA)
  misc_feature (7)..(7): 5-methyl
agauggcauut

SEQ ID NO: 4849 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (10)..(10): bicyclic nucleic acid (BNA)
  misc_feature (7)..(7): 5-methyl
agauggcaut

SEQ ID NO: 4850 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (7)..(7): 5-methyl
agauggcat

SEQ ID NO: 4851 - RNA, 8 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (7)..(7): 5-methyl
agauggca

SEQ ID NO: 4852 - RNA, 30 nt, Artificial Sequence; identical to SEQ ID NO: 287
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(1): bicyclic nucleic acid (BNA)
  misc_feature (30)..(30): bicyclic nucleic acid (BNA)

SEQ ID NO: 4853 - RNA, 29 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(1): bicyclic nucleic acid (BNA)
  misc_feature (29)..(29): bicyclic nucleic acid (BNA)
cuccaacaucaaggaagauggcauuucua

SEQ ID NO: 4854 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(1): bicyclic nucleic acid (BNA)
  misc_feature (28)..(28): bicyclic nucleic acid (BNA)
cuccaacaucaaggaagauggcauuuct

SEQ ID NO: 4855 - RNA, 27 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(1): bicyclic nucleic acid (BNA)
  misc_feature (27)..(27): bicyclic nucleic acid (BNA)
cuccaacaucaaggaagauggcauuuc

SEQ ID NO: 4856 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
  misc_feature (26)..(26): bicyclic nucleic acid (BNA)
cuccaacaucaaggaagauggcauut

SEQ ID NO: 4857 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
  misc_feature (25)..(25): bicyclic nucleic acid (BNA)
cuccaacaucaaggaagauggcaut

SEQ ID NO: 4858 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
  misc_feature (24)..(24): bicyclic nucleic acid (BNA)
cuccaacaucaaggaagauggcat

SEQ ID NO: 4859 - RNA, 23 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
  misc_feature (23)..(23): bicyclic nucleic acid (BNA)
cuccaacaucaaggaagauggca

SEQ ID NO: 4860 - RNA, 22 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
  misc_feature (22)..(22): bicyclic nucleic acid (BNA)
cuccaacaucaaggaagauggc

SEQ ID NO: 4861 - RNA, 21 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
  misc_feature (21)..(21): bicyclic nucleic acid (BNA)
cuccaacaucaaggaagaugg

SEQ ID NO: 4862 - RNA, 20 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
  misc_feature (20)..(20): bicyclic nucleic acid (BNA)
cuccaacaucaaggaagaug

SEQ ID NO: 4863 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
  misc_feature (19)..(19): bicyclic nucleic acid (BNA)
cuccaacaucaaggaagat

SEQ ID NO: 4864 - RNA, 18 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
  misc_feature (18)..(18): bicyclic nucleic acid (BNA)
cuccaacaucaaggaaga

SEQ ID NO: 4865 - RNA, 17 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
  misc_feature (17)..(17): bicyclic nucleic acid (BNA)
cuccaacaucaaggaag

SEQ ID NO: 4866 - DNA, 29 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (29)..(29): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacaucaaggaagauggcauuucuag

SEQ ID NO: 4867 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (28)..(28): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacaucaaggaagauggcauuucua

SEQ ID NO: 4868 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (27)..(27): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacaucaaggaagauggcauuuct

SEQ ID NO: 4869 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (26)..(26): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacaucaaggaagauggcauuuc

SEQ ID NO: 4870 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (25)..(25): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggcauut

SEQ ID NO: 4871 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (24)..(24): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggcaut

SEQ ID NO: 4872 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (23)..(23): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggcat

SEQ ID NO: 4873 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (22)..(22): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggca

SEQ ID NO: 4874 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (21)..(21): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggc

SEQ ID NO: 4875 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
  misc_feature (2)..(3): 5-methyl
  misc_feature (6)..(6): 5-methyl
  misc_feature (9)..(9): 5-methyl
tccaacaucaaggaagaugg

SEQ ID NO: 4876 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
  misc_feature (2)..(3): 5-methyl
  misc_feature (6)..(6): 5-methyl
  misc_feature (9)..(9): 5-methyl
tccaacaucaaggaagaug

SEQ ID NO: 4877 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
  misc_feature (2)..(3): 5-methyl
  misc_feature (6)..(6): 5-methyl
  misc_feature (9)..(9): 5-methyl
tccaacaucaaggaagat

SEQ ID NO: 4878 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
  misc_feature (2)..(3): 5-methyl
  misc_feature (6)..(6): 5-methyl
  misc_feature (9)..(9): 5-methyl
tccaacaucaaggaaga

SEQ ID NO: 4879 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
  misc_feature (2)..(3): 5-methyl
  misc_feature (6)..(6): 5-methyl
  misc_feature (9)..(9): 5-methyl
tccaacaucaaggaag

SEQ ID NO: 4880 - RNA, 28 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(1): bicyclic nucleic acid (BNA)
  misc_feature (28)..(28): bicyclic nucleic acid (BNA)
ccaacaucaaggaagauggcauuucuag

SEQ ID NO: 4881 - RNA, 27 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(1): bicyclic nucleic acid (BNA)
  misc_feature (27)..(27): bicyclic nucleic acid (BNA)
ccaacaucaaggaagauggcauuucua

SEQ ID NO: 4882 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(1): bicyclic nucleic acid (BNA)
  misc_feature (26)..(26): bicyclic nucleic acid (BNA)
ccaacaucaaggaagauggcauuuct

SEQ ID NO: 4883 - RNA, 25 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(1): bicyclic nucleic acid (BNA)
  misc_feature (25)..(25): bicyclic nucleic acid (BNA)
ccaacaucaaggaagauggcauuuc

SEQ ID NO: 4884 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
  misc_feature (24)..(24): bicyclic nucleic acid (BNA)
ccaacaucaaggaagauggcauut

SEQ ID NO: 4885 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
  misc_feature (23)..(23): bicyclic nucleic acid (BNA)
ccaacaucaaggaagauggcaut

SEQ ID NO: 4886 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
  misc_feature (22)..(22): bicyclic nucleic acid (BNA)
ccaacaucaaggaagauggcat

SEQ ID NO: 4887 - RNA, 21 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
  misc_feature (21)..(21): bicyclic nucleic acid (BNA)
ccaacaucaaggaagauggca

SEQ ID NO: 4888 - RNA, 20 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
  misc_feature (20)..(20): bicyclic nucleic acid (BNA)
ccaacaucaaggaagauggc

SEQ ID NO: 4889 - RNA, 19 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
  misc_feature (19)..(19): bicyclic nucleic acid (BNA)
ccaacaucaaggaagaugg

SEQ ID NO: 4890 - RNA, 18 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
  misc_feature (18)..(18): bicyclic nucleic acid (BNA)
ccaacaucaaggaagaug

SEQ ID NO: 4891 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
  misc_feature (17)..(17): bicyclic nucleic acid (BNA)
ccaacaucaaggaagat

SEQ ID NO: 4892 - RNA, 16 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
  misc_feature (16)..(16): bicyclic nucleic acid (BNA)
ccaacaucaaggaaga

SEQ ID NO: 4893 - RNA, 15 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
  misc_feature (15)..(15): bicyclic nucleic acid (BNA)
ccaacaucaaggaag

SEQ ID NO: 4894 - RNA, 27 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(1): bicyclic nucleic acid (BNA)
  misc_feature (27)..(27): bicyclic nucleic acid (BNA)
caacaucaaggaagauggcauuucuag

SEQ ID NO: 4895 - RNA, 26 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(1): bicyclic nucleic acid (BNA)
  misc_feature (26)..(26): bicyclic nucleic acid (BNA)
caacaucaaggaagauggcauuucua

SEQ ID NO: 4896 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(1): bicyclic nucleic acid (BNA)
  misc_feature (25)..(25): bicyclic nucleic acid (BNA)
caacaucaaggaagauggcauuuct

SEQ ID NO: 4897 - RNA, 24 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(1): bicyclic nucleic acid (BNA)
  misc_feature (24)..(24): bicyclic nucleic acid (BNA)
caacaucaaggaagauggcauuuc

SEQ ID NO: 4898 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
  misc_feature (23)..(23): bicyclic nucleic acid (BNA)
caacaucaaggaagauggcauut

SEQ ID NO: 4899 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
  misc_feature (22)..(22): bicyclic nucleic acid (BNA)
caacaucaaggaagauggcaut

SEQ ID NO: 4900 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
  misc_feature (21)..(21): bicyclic nucleic acid (BNA)
caacaucaaggaagauggcat

SEQ ID NO: 4901 - RNA, 20 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
  misc_feature (20)..(20): bicyclic nucleic acid (BNA)
caacaucaaggaagauggca

SEQ ID NO: 4902 - RNA, 19 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
  misc_feature (19)..(19): bicyclic nucleic acid (BNA)
caacaucaaggaagauggc

SEQ ID NO: 4903 - RNA, 18 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
  misc_feature (18)..(18): bicyclic nucleic acid (BNA)
caacaucaaggaagaugg

SEQ ID NO: 4904 - RNA, 17 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
  misc_feature (17)..(17): bicyclic nucleic acid (BNA)
caacaucaaggaagaug

SEQ ID NO: 4905 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
  misc_feature (16)..(16): bicyclic nucleic acid (BNA)
caacaucaaggaagat

SEQ ID NO: 4906 - RNA, 15 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
  misc_feature (15)..(15): bicyclic nucleic acid (BNA)
caacaucaaggaaga

SEQ ID NO: 4907 - RNA, 14 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
  misc_feature (14)..(14): bicyclic nucleic acid (BNA)
caacaucaaggaag

SEQ ID NO: 4908 - RNA, 26 nt, Artificial Sequence
  Description of Artificial Sequence: Synthetic Antisense oligonucleotide
  misc_feature (1)..(1): bicyclic nucleic acid (BNA)
  misc_feature (26)..(26): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuucuag

SEQ ID NO: 4909 - RNA, 25 nt, Artificial Sequence
  Description of Artificial Sequence: Synthetic Antisense oligonucleotide
  misc_feature (1)..(1): bicyclic nucleic acid (BNA)
  misc_feature (25)..(25): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuucua

SEQ ID NO: 4910 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (24)..(24): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuuct

SEQ ID NO: 4911 - RNA, 23 nt, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuuc

SEQ ID NO: 4912 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (22)..(22): bicyclic nucleic acid (BNA)
  misc_feature (3)..(3): 5-methyl
  misc_feature (6)..(6): 5-methyl
  misc_feature (18)..(18): 5-methyl
aacaucaaggaagauggcauut

SEQ ID NO: 4913 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (21)..(21): bicyclic nucleic acid (BNA)
  misc_feature (3)..(3): 5-methyl
  misc_feature (6)..(6): 5-methyl
  misc_feature (18)..(18): 5-methyl
aacaucaaggaagauggcaut

SEQ ID NO: 4914 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
  misc_feature (3)..(3): 5-methyl
  misc_feature (6)..(6): 5-methyl
  misc_feature (18)..(18): 5-methyl
aacaucaaggaagauggcat

SEQ ID NO: 4915 - RNA, 19 nt, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (3)..(3): 5-methyl
  misc_feature (6)..(6): 5-methyl
  misc_feature (18)..(18): 5-methyl
aacaucaaggaagauggca

SEQ ID NO: 4916 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (3)..(3): 5-methyl
  misc_feature (6)..(6): 5-methyl
  misc_feature (18)..(18): 5-methyl
aacaucaaggaagauggc

SEQ ID NO: 4917 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (3)..(3): 5-methyl
  misc_feature (6)..(6): 5-methyl
aacaucaaggaagaugg

SEQ ID NO: 4918 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (3)..(3): 5-methyl
  misc_feature (6)..(6): 5-methyl
aacaucaaggaagaug

SEQ ID NO: 4919 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
  misc_feature (3)..(3): 5-methyl
  misc_feature (6)..(6): 5-methyl
aacaucaaggaagat

SEQ ID NO: 4920 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (3)..(3): 5-methyl
  misc_feature (6)..(6): 5-methyl
aacaucaaggaaga

SEQ ID NO: 4921 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (3)..(3): 5-methyl
  misc_feature (6)..(6): 5-methyl
aacaucaaggaag

SEQ ID NO: 4922 - RNA, 25 nt, Artificial Sequence
  Description of Artificial Sequence: Synthetic Antisense oligonucleotide
  misc_feature (1)..(1): bicyclic nucleic acid (BNA)
  misc_feature (25)..(25): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuucuag

SEQ ID NO: 4923 - RNA, 24 nt, Artificial Sequence
  Description of Artificial Sequence: Synthetic Antisense oligonucleotide
  misc_feature (1)..(1): bicyclic nucleic acid (BNA)
  misc_feature (24)..(24): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuucua

SEQ ID NO: 4924 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (23)..(23): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuuct

SEQ ID NO: 4925 - RNA, 22 nt, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuuc

SEQ ID NO: 4926 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (21)..(21): bicyclic nucleic acid (BNA)
  misc_feature (2)..(2): 5-methyl
  misc_feature (5)..(5): 5-methyl
  misc_feature (17)..(17): 5-methyl
acaucaaggaagauggcauut

SEQ ID NO: 4927 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
  misc_feature (2)..(2): 5-methyl
  misc_feature (5)..(5): 5-methyl
  misc_feature (17)..(17): 5-methyl
acaucaaggaagauggcaut

SEQ ID NO: 4928 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
  misc_feature (2)..(2): 5-methyl
  misc_feature (5)..(5): 5-methyl
  misc_feature (17)..(17): 5-methyl
acaucaaggaagauggcat

SEQ ID NO: 4929 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (2)..(2): 5-methyl
  misc_feature (5)..(5): 5-methyl
  misc_feature (17)..(17): 5-methyl
acaucaaggaagauggca

SEQ ID NO: 4930 - RNA, 17 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (2)..(2): 5-methyl
  misc_feature (5)..(5): 5-methyl
  misc_feature (17)..(17): 5-methyl
acaucaaggaagauggc

SEQ ID NO: 4931 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (2)..(2): 5-methyl
  misc_feature (5)..(5): 5-methyl
acaucaaggaagaugg

SEQ ID NO: 4932 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (2)..(2): 5-methyl
  misc_feature (5)..(5): 5-methyl
acaucaaggaagaug

SEQ ID NO: 4933 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (2)..(2): 5-methyl
  misc_feature (5)..(5): 5-methyl
acaucaaggaagat

SEQ ID NO: 4934 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (2)..(2): 5-methyl
  misc_feature (5)..(5): 5-methyl
acaucaaggaaga

SEQ ID NO: 4935 - RNA, 12 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (2)..(2): 5-methyl
  misc_feature (5)..(5): 5-methyl
acaucaaggaag

SEQ ID NO: 4936 - RNA, 24 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(1): bicyclic nucleic acid (BNA)
  misc_feature (24)..(24): bicyclic nucleic acid (BNA)
caucaaggaagauggcauuucuag

SEQ ID NO: 4937 - RNA, 23 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(1): bicyclic nucleic acid (BNA)
  misc_feature (23)..(23): bicyclic nucleic acid (BNA)
caucaaggaagauggcauuucua

SEQ ID NO: 4938 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(1): bicyclic nucleic acid (BNA)
  misc_feature (22)..(22): bicyclic nucleic acid (BNA)
caucaaggaagauggcauuuct

SEQ ID NO: 4939 - RNA, 21 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(1): bicyclic nucleic acid (BNA)
  misc_feature (21)..(21): bicyclic nucleic acid (BNA)
caucaaggaagauggcauuuc

SEQ ID NO: 4940 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
  misc_feature (20)..(20): bicyclic nucleic acid (BNA)
caucaaggaagauggcauut

SEQ ID NO: 4941 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
  misc_feature (19)..(19): bicyclic nucleic acid (BNA)
caucaaggaagauggcaut

SEQ ID NO: 4942 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
  misc_feature (18)..(18): bicyclic nucleic acid (BNA)
caucaaggaagauggcat

SEQ ID NO: 4943 - RNA, 17 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
  misc_feature (17)..(17): bicyclic nucleic acid (BNA)
caucaaggaagauggca

SEQ ID NO: 4944 - RNA, 16 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
  misc_feature (16)..(16): bicyclic nucleic acid (BNA)
caucaaggaagauggc

SEQ ID NO: 4945 - RNA, 15 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
  misc_feature (15)..(15): bicyclic nucleic acid (BNA)
caucaaggaagaugg

SEQ ID NO: 4946 - RNA, 14 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
  misc_feature (14)..(14): bicyclic nucleic acid (BNA)
caucaaggaagaug

SEQ ID NO: 4947 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (1)..(1): bicyclic nucleic acid (BNA)
  misc_feature (13)..(13): bicyclic nucleic acid (BNA)
caucaaggaagat

SEQ ID NO: 4948 - RNA, 12 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
  misc_feature (12)..(12): bicyclic nucleic acid (BNA)
caucaaggaaga

SEQ ID NO: 4949 - RNA, 11 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
  misc_feature (11)..(11): bicyclic nucleic acid (BNA)
caucaaggaag

SEQ ID NO: 4950 - RNA, 23 nt, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
  misc_feature (3)..(3): 5-methyl
  misc_feature (15)..(15): 5-methyl
  misc_feature (20)..(20): 5-methyl
aucaaggaagauggcauuucuag

SEQ ID NO: 4951 - RNA, 22 nt, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
  misc_feature (3)..(3): 5-methyl
  misc_feature (15)..(15): 5-methyl
  misc_feature (20)..(20): 5-methyl
aucaaggaagauggcauuucua

SEQ ID NO: 4952 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (21)..(21): bicyclic nucleic acid (BNA)
  misc_feature (3)..(3): 5-methyl
  misc_feature (15)..(15): 5-methyl
  misc_feature (20)..(20): 5-methyl
aucaaggaagauggcauuuct

SEQ ID NO: 4953 - RNA, 20 nt, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (3)..(3): 5-methyl
  misc_feature (15)..(15): 5-methyl
  misc_feature (20)..(20): 5-methyl
aucaaggaagauggcauuuc

SEQ ID NO: 4954 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
  misc_feature (3)..(3): 5-methyl
  misc_feature (15)..(15): 5-methyl
aucaaggaagauggcauut

SEQ ID NO: 4955 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (18)..(18): bicyclic nucleic acid (BNA)
  misc_feature (3)..(3): 5-methyl
  misc_feature (15)..(15): 5-methyl
aucaaggaagauggcaut

SEQ ID NO: 4956 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (17)..(17): bicyclic nucleic acid (BNA)
  misc_feature (3)..(3): 5-methyl
  misc_feature (15)..(15): 5-methyl
aucaaggaagauggcat

SEQ ID NO: 4957 - RNA, 16 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (3)..(3): 5-methyl
  misc_feature (15)..(15): 5-methyl
aucaaggaagauggca

SEQ ID NO: 4958 - RNA, 15 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (3)..(3): 5-methyl
  misc_feature (15)..(15): 5-methyl
aucaaggaagauggc

SEQ ID NO: 4959 - RNA, 14 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (3)..(3): 5-methyl
aucaaggaagaugg

SEQ ID NO: 4960 - RNA, 13 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (3)..(3): 5-methyl
aucaaggaagaug

SEQ ID NO: 4961 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (3)..(3): 5-methyl
aucaaggaagat

SEQ ID NO: 4962 - RNA, 11 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (3)..(3): 5-methyl
aucaaggaaga

SEQ ID NO: 4963 - RNA, 10 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (3)..(3): 5-methyl
aucaaggaag

SEQ ID NO: 4964 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 4965 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 4966 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 4967 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
ctguccaagcccgguuga

SEQ ID NO: 4968 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(7): 5-methyl
  misc_feature (11)..(12): 5-methyl
taaguucuguccaag

SEQ ID NO: 4969 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(14): 5-methyl
ttcuguccaagcccgguuga

SEQ ID NO: 4970 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(14): 5-methyl
ttcuguccaagcccgguug

SEQ ID NO: 4971 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(14): 5-methyl
ttcuguccaagcccgguu

SEQ ID NO: 4972 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(14): 5-methyl
ttcuguccaagcccggu

SEQ ID NO: 4973 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(14): 5-methyl
ttcuguccaagcccgg

SEQ ID NO: 4974 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(14): 5-methyl
ttcuguccaagcccg

SEQ ID NO: 4975 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(14): 5-methyl
ttcuguccaagccc

SEQ ID NO: 4976 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(13): 5-methyl
ttcuguccaagcc

SEQ ID NO: 4977 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(12): 5-methyl
ttcuguccaagc

SEQ ID NO: 4978 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (7)..(8): 5-methyl
ttcuguccaag

SEQ ID NO: 4979 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (7)..(8): 5-methyl
ttcuguccaa

SEQ ID NO: 4980 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (7)..(8): 5-methyl
ttcugucca

SEQ ID NO: 4981 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (7)..(8): 5-methyl
ttcugucc

SEQ ID NO: 4982 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(13): 5-methyl
tcuguccaagcccgguuga

SEQ ID NO: 4983 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(13): 5-methyl
tcuguccaagcccgguug

SEQ ID NO: 4984 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(13): 5-methyl
tcuguccaagcccgguu

SEQ ID NO: 4985 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(13): 5-methyl
tcuguccaagcccggu

SEQ ID NO: 4986 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(13): 5-methyl
tcuguccaagcccgg

SEQ ID NO: 4987 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(13): 5-methyl
tcuguccaagcccg

SEQ ID NO: 4988 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(13): 5-methyl
tcuguccaagccc

SEQ ID NO: 4989 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(12): 5-methyl
tcuguccaagcc

SEQ ID NO: 4990 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(11): 5-methyl
tcuguccaagc

SEQ ID NO: 4991 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (6)..(7): 5-methyl
tcuguccaag

SEQ ID NO: 4992 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (6)..(7): 5-methyl
tcuguccaa

SEQ ID NO: 4993 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (6)..(7): 5-methyl
tcugucca

SEQ ID NO: 4994 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
ctguccaagcccgguug

SEQ ID NO: 4995 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
ctguccaagcccgguu

SEQ ID NO: 4996 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
ctguccaagcccggu

SEQ ID NO: 4997 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
ctguccaagcccgg

SEQ ID NO: 4998 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
ctguccaagcccg

SEQ ID NO: 4999 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
ctguccaagccc

SEQ ID NO: 5000 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(11): 5-methyl
  misc_feature (1)..(2): bicyclic nucleic acid (BNA)
ctguccaagcc

SEQ ID NO: 5001 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(10): 5-methyl
  misc_feature (1)..(2): bicyclic nucleic acid (BNA)
ctguccaagc

SEQ ID NO: 5002 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (1)..(2): bicyclic nucleic acid (BNA)
ctguccaag

SEQ ID NO: 5003 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (1)..(2): bicyclic nucleic acid (BNA)
ctguccaa

SEQ ID NO: 5004 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (4)..(4): 5-methyl
  misc_feature (8)..(9): 5-methyl
  misc_feature (13)..(15): 5-methyl
gtucuguccaagcccgguug

SEQ ID NO: 5005 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (4)..(4): 5-methyl
  misc_feature (8)..(9): 5-methyl
  misc_feature (13)..(15): 5-methyl
gtucuguccaagcccgguu

SEQ ID NO: 5006 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (4)..(4): 5-methyl
  misc_feature (8)..(9): 5-methyl
  misc_feature (13)..(15): 5-methyl
gtucuguccaagcccggu

SEQ ID NO: 5007 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (4)..(4): 5-methyl
  misc_feature (8)..(9): 5-methyl
  misc_feature (13)..(15): 5-methyl
gtucuguccaagcccgg

SEQ ID NO: 5008 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (4)..(4): 5-methyl
  misc_feature (8)..(9): 5-methyl
  misc_feature (13)..(15): 5-methyl
gtucuguccaagcccg

SEQ ID NO: 5009 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (4)..(4): 5-methyl
  misc_feature (8)..(9): 5-methyl
  misc_feature (13)..(15): 5-methyl
gtucuguccaagccc

SEQ ID NO: 5010 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (4)..(4): 5-methyl
  misc_feature (8)..(9): 5-methyl
  misc_feature (13)..(14): 5-methyl
gtucuguccaagcc

SEQ ID NO: 5011 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (4)..(4): 5-methyl
  misc_feature (8)..(9): 5-methyl
  misc_feature (13)..(13): 5-methyl
gtucuguccaagc

SEQ ID NO: 5012 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (4)..(4): 5-methyl
  misc_feature (8)..(9): 5-methyl
gtucuguccaag

SEQ ID NO: 5013 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (4)..(4): 5-methyl
  misc_feature (8)..(9): 5-methyl
gtucuguccaa

SEQ ID NO: 5014 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (4)..(4): 5-methyl
  misc_feature (8)..(9): 5-methyl
gtucugucca

SEQ ID NO: 5015 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (4)..(4): 5-methyl
  misc_feature (8)..(9): 5-methyl
gtucugucc

SEQ ID NO: 5016 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (4)..(4): 5-methyl
  misc_feature (8)..(8): 5-methyl
gtucuguc

SEQ ID NO: 5017 - RNA, 20 nt, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
  misc_feature (14)..(16): 5-methyl
aguucuguccaagcccgguu

SEQ ID NO: 5018 - RNA, 19 nt, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
  misc_feature (14)..(16): 5-methyl
aguucuguccaagcccggu

SEQ ID NO: 5019 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
  misc_feature (14)..(16): 5-methyl
aguucuguccaagcccgg

SEQ ID NO: 5020 - RNA, 17 nt, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
  misc_feature (14)..(16): 5-methyl
aguucuguccaagcccg

SEQ ID NO: 5021 - RNA, 16 nt, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
  misc_feature (14)..(16): 5-methyl
aguucuguccaagccc

SEQ ID NO: 5022 - RNA, 15 nt, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
  misc_feature (14)..(15): 5-methyl
aguucuguccaagcc

SEQ ID NO: 5023 - RNA, 14 nt, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
  misc_feature (14)..(14): 5-methyl
aguucuguccaagc

SEQ ID NO: 5024 - RNA, 13 nt, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
aguucuguccaag

SEQ ID NO: 5025 - RNA, 12 nt, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
aguucuguccaa

SEQ ID NO: 5026 - RNA, 11 nt, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
aguucugucca

SEQ ID NO: 5027 - RNA, 10 nt, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
aguucugucc

SEQ ID NO: 5028 - RNA, 9 nt, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(9): 5-methyl
aguucuguc

SEQ ID NO: 5029 - RNA, 8 nt, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
aguucugu

SEQ ID NO: 5030 - RNA, 20 nt, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
  misc_feature (15)..(17): 5-methyl
aaguucuguccaagcccggu

SEQ ID NO: 5031 - RNA, 19 nt, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
  misc_feature (15)..(17): 5-methyl
aaguucuguccaagcccgg

SEQ ID NO: 5032 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
  misc_feature (15)..(17): 5-methyl
aaguucuguccaagcccg

SEQ ID NO: 5033 - RNA, 17 nt, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
  misc_feature (15)..(17): 5-methyl
aaguucuguccaagccc

SEQ ID NO: 5034 - RNA, 16 nt, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
  misc_feature (15)..(16): 5-methyl
aaguucuguccaagcc

SEQ ID NO: 5035 - RNA, 15 nt, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
  misc_feature (15)..(15): 5-methyl
aaguucuguccaagc

SEQ ID NO: 5036 - RNA, 14 nt, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
aaguucuguccaag

SEQ ID NO: 5037 - RNA, 13 nt, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
aaguucuguccaa

SEQ ID NO: 5038 - RNA, 12 nt, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
aaguucugucca

SEQ ID NO: 5039 - RNA, 11 nt, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
aaguucugucc

SEQ ID NO: 5040 - RNA, 10 nt, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(10): 5-methyl
aaguucuguc

SEQ ID NO: 5041 - RNA, 9 nt, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
aaguucugu

SEQ ID NO: 5042 - RNA, 8 nt, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
aaguucug

SEQ ID NO: 5043 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(7): 5-methyl
  misc_feature (11)..(12): 5-methyl
  misc_feature (16)..(18): 5-methyl
taaguucuguccaagcccgg

SEQ ID NO: 5044 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(7): 5-methyl
  misc_feature (11)..(12): 5-methyl
  misc_feature (16)..(18): 5-methyl
taaguucuguccaagcccg

SEQ ID NO: 5045 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(7): 5-methyl
  misc_feature (11)..(12): 5-methyl
  misc_feature (16)..(18): 5-methyl
taaguucuguccaagccc

SEQ ID NO: 5046 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(7): 5-methyl
  misc_feature (11)..(12): 5-methyl
  misc_feature (16)..(17): 5-methyl
taaguucuguccaagcc

SEQ ID NO: 5047 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(7): 5-methyl
  misc_feature (11)..(12): 5-methyl
  misc_feature (16)..(16): 5-methyl
taaguucuguccaagc

SEQ ID NO: 5048 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(7): 5-methyl
  misc_feature (11)..(12): 5-methyl
taaguucuguccaa

SEQ ID NO: 5049 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(7): 5-methyl
  misc_feature (11)..(12): 5-methyl
taaguucugucca

SEQ ID NO: 5050 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(7): 5-methyl
  misc_feature (11)..(12): 5-methyl
taaguucugucc

SEQ ID NO: 5051 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(7): 5-methyl
  misc_feature (11)..(11): 5-methyl
taaguucuguc

SEQ ID NO: 5052 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(7): 5-methyl
taaguucugu

SEQ ID NO: 5053 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(7): 5-methyl
taaguucug

SEQ ID NO: 5054 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(7): 5-methyl
taaguucu

SEQ ID NO: 5055 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): 5-methyl
  misc_feature (12)..(13): 5-methyl
  misc_feature (17)..(19): 5-methyl
gtaaguucuguccaagcccg

SEQ ID NO: 5056 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): 5-methyl
  misc_feature (12)..(13): 5-methyl
  misc_feature (17)..(19): 5-methyl
gtaaguucuguccaagccc

SEQ ID NO: 5057 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): 5-methyl
  misc_feature (12)..(13): 5-methyl
  misc_feature (17)..(17): 5-methyl
gtaaguucuguccaagc

SEQ ID NO: 5058 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): 5-methyl
  misc_feature (12)..(13): 5-methyl
gtaaguucuguccaag

SEQ ID NO: 5059 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): 5-methyl
  misc_feature (12)..(13): 5-methyl
gtaaguucuguccaa

SEQ ID NO: 5060 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): 5-methyl
  misc_feature (12)..(13): 5-methyl
gtaaguucugucca

SEQ ID NO: 5061 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): 5-methyl
  misc_feature (12)..(13): 5-methyl
gtaaguucugucc

SEQ ID NO: 5062 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): 5-methyl
  misc_feature (12)..(12): 5-methyl
gtaaguucuguc

SEQ ID NO: 5063 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): 5-methyl
gtaaguucugu

SEQ ID NO: 5064 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): 5-methyl
gtaaguucug

SEQ ID NO: 5065 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): 5-methyl
gtaaguucu

SEQ ID NO: 5066 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): 5-methyl
gtaaguuc

SEQ ID NO: 5067 - RNA, 20 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (13)..(14): 5-methyl
  misc_feature (18)..(20): 5-methyl
gguaaguucuguccaagccc

SEQ ID NO: 5068 - RNA, 19 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (13)..(14): 5-methyl
  misc_feature (18)..(19): 5-methyl
gguaaguucuguccaagcc

SEQ ID NO: 5069 - RNA, 17 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (13)..(14): 5-methyl
gguaaguucuguccaag

SEQ ID NO: 5070 - RNA, 16 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (13)..(14): 5-methyl
gguaaguucuguccaa

SEQ ID NO: 5071 - RNA, 15 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (13)..(14): 5-methyl
gguaaguucugucca

SEQ ID NO: 5072 - RNA, 14 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (13)..(14): 5-methyl
gguaaguucugucc

SEQ ID NO: 5073 - RNA, 13 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (13)..(13): 5-methyl
gguaaguucuguc

SEQ ID NO: 5074 - RNA, 12 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
gguaaguucugu

SEQ ID NO: 5075 - RNA, 11 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
gguaaguucug

SEQ ID NO: 5076 - RNA, 10 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
gguaaguucu

SEQ ID NO: 5077 - RNA, 9 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
gguaaguuc

SEQ ID NO: 5078 - RNA, 20 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(20): 5-methyl
  misc_feature (1)..(2): bicyclic nucleic acid (BNA)
cgguaaguucuguccaagcc

SEQ ID NO: 5079 - RNA, 19 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(19): 5-methyl
  misc_feature (1)..(2): bicyclic nucleic acid (BNA)
cgguaaguucuguccaagc

SEQ ID NO: 5080 - RNA, 18 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(2): bicyclic nucleic acid (BNA)
cgguaaguucuguccaag

SEQ ID NO: 5081 - RNA, 17 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(2): bicyclic nucleic acid (BNA)
cgguaaguucuguccaa

SEQ ID NO: 5082 - RNA, 16 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(2): bicyclic nucleic acid (BNA)
cgguaaguucugucca

SEQ ID NO: 5083 - RNA, 15 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(2): bicyclic nucleic acid (BNA)
cgguaaguucugucc

SEQ ID NO: 5084 - RNA, 14 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(14): 5-methyl
  misc_feature (1)..(2): bicyclic nucleic acid (BNA)
cgguaaguucuguc

SEQ ID NO: 5085 - RNA, 13 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(2): bicyclic nucleic acid (BNA)
cgguaaguucugu

SEQ ID NO: 5086 - RNA, 12 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(2): bicyclic nucleic acid (BNA)
cgguaaguucug

SEQ ID NO: 5087 - RNA, 11 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(2): bicyclic nucleic acid (BNA)
cgguaaguucu

SEQ ID NO: 5088 - RNA, 10 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(2): bicyclic nucleic acid (BNA)
cgguaaguuc

SEQ ID NO: 5089 - RNA, 9 nt, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
cgguaaguu

SEQ ID NO: 5090 - RNA, 8 nt, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
cgguaagu

SEQ ID NO: 5091 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (11)..(11): 5-methyl
  misc_feature (15)..(16): 5-methyl
  misc_feature (20)..(20): 5-methyl
tcgguaaguucuguccaagc

SEQ ID NO: 5092 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (11)..(11): 5-methyl
  misc_feature (15)..(16): 5-methyl
tcgguaaguucuguccaag

SEQ ID NO: 5093 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (11)..(11): 5-methyl
  misc_feature (15)..(16): 5-methyl
tcgguaaguucuguccaa

SEQ ID NO: 5094 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (11)..(11): 5-methyl
  misc_feature (15)..(16): 5-methyl
tcgguaaguucugucca

SEQ ID NO: 5095 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (11)..(11): 5-methyl
  misc_feature (15)..(16): 5-methyl
tcgguaaguucugucc

SEQ ID NO: 5096 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (11)..(11): 5-methyl
  misc_feature (15)..(15): 5-methyl
tcgguaaguucuguc

SEQ ID NO: 5097 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (11)..(11): 5-methyl
tcgguaaguucugu

SEQ ID NO: 5098 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (11)..(11): 5-methyl
tcgguaaguucug

SEQ ID NO: 5099 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (11)..(11): 5-methyl
tcgguaaguucu

SEQ ID NO: 5100 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (11)..(11): 5-methyl
tcgguaaguuc

SEQ ID NO: 5101 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
tcgguaaguu

SEQ ID NO: 5102 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
tcgguaagu

SEQ ID NO: 5103 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (12)..(12): 5-methyl
  misc_feature (16)..(17): 5-methyl
gtcgguaaguucuguccaag

SEQ ID NO: 5104 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (12)..(12): 5-methyl
  misc_feature (16)..(17): 5-methyl
gtcgguaaguucuguccaa

SEQ ID NO: 5105 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (12)..(12): 5-methyl
  misc_feature (16)..(17): 5-methyl
gtcgguaaguucugucca

SEQ ID NO: 5106 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (12)..(12): 5-methyl
  misc_feature (16)..(17): 5-methyl
gtcgguaaguucugucc

SEQ ID NO: 5107 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (12)..(12): 5-methyl
  misc_feature (16)..(16): 5-methyl
gtcgguaaguucuguc

SEQ ID NO: 5108 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (12)..(12): 5-methyl
gtcgguaaguucugu

SEQ ID NO: 5109 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (12)..(12): 5-methyl
gtcgguaaguucug

SEQ ID NO: 5110 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (12)..(12): 5-methyl
gtcgguaaguucu

SEQ ID NO: 5111 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (12)..(12): 5-methyl
gtcgguaaguuc

SEQ ID NO: 5112 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
gtcgguaaguu

SEQ ID NO: 5113 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
gtcgguaagu

SEQ ID NO: 5114 - RNA, 20 nt, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (13)..(13): 5-methyl
  misc_feature (17)..(18): 5-methyl
agucgguaaguucuguccaa

SEQ ID NO: 5115 - RNA, 19 nt, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (13)..(13): 5-methyl
  misc_feature (17)..(18): 5-methyl
agucgguaaguucugucca

SEQ ID NO: 5116 - RNA, 17 nt, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (13)..(13): 5-methyl
  misc_feature (17)..(17): 5-methyl
agucgguaaguucuguc

SEQ ID NO: 5117 - RNA, 16 nt, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (13)..(13): 5-methyl
agucgguaaguucugu

SEQ ID NO: 5118 - RNA, 15 nt, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (13)..(13): 5-methyl
agucgguaaguucug

SEQ ID NO: 5119 - RNA, 14 nt, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (13)..(13): 5-methyl
agucgguaaguucu

SEQ ID NO: 5120 - RNA, 13 nt, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (13)..(13): 5-methyl
agucgguaaguuc

SEQ ID NO: 5121 - RNA, 12 nt, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
agucgguaaguu

SEQ ID NO: 5122 - RNA, 11 nt, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
agucgguaagu

SEQ ID NO: 5123 - RNA, 20 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (1)..(2): bicyclic nucleic acid (BNA)
cagucgguaaguucugucca

SEQ ID NO: 5124 - RNA, 19 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (1)..(2): bicyclic nucleic acid (BNA)
cagucgguaaguucugucc

SEQ ID NO: 5125 - RNA, 18 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(18): 5-methyl
  misc_feature (1)..(2): bicyclic nucleic acid (BNA)
cagucgguaaguucuguc

SEQ ID NO: 5126 - RNA, 17 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(2): bicyclic nucleic acid (BNA)
cagucgguaaguucugu

SEQ ID NO: 5127 - RNA, 16 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(2): bicyclic nucleic acid (BNA)
cagucgguaaguucug

SEQ ID NO: 5128 - RNA, 15 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(2): bicyclic nucleic acid (BNA)
cagucgguaaguucu

SEQ ID NO: 5129 - RNA, 14 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(2): bicyclic nucleic acid (BNA)
cagucgguaaguuc

SEQ ID NO: 5130 - RNA, 13 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (1)..(2): bicyclic nucleic acid (BNA)
cagucgguaaguu

SEQ ID NO: 5131 - RNA, 12 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (1)..(2): bicyclic nucleic acid (BNA)
cagucgguaagu

SEQ ID NO: 5132 - RNA, 20 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(20): 5-methyl
  misc_feature (1)..(2): bicyclic nucleic acid (BNA)
ccagucgguaaguucugucc

SEQ ID NO: 5133 - RNA, 19 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(19): 5-methyl
  misc_feature (1)..(2): bicyclic nucleic acid (BNA)
ccagucgguaaguucuguc

SEQ ID NO: 5134 - RNA, 18 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(2): bicyclic nucleic acid (BNA)
ccagucgguaaguucugu

SEQ ID NO: 5135 - RNA, 17 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(2): bicyclic nucleic acid (BNA)
ccagucgguaaguucug

SEQ ID NO: 5136 - RNA, 16 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(2): bicyclic nucleic acid (BNA)
ccagucgguaaguucu

SEQ ID NO: 5137 - RNA, 15 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(2): bicyclic nucleic acid (BNA)
ccagucgguaaguuc

SEQ ID NO: 5138 - RNA, 14 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (1)..(2): bicyclic nucleic acid (BNA)
ccagucgguaaguu

SEQ ID NO: 5139 - RNA, 13 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (1)..(2): bicyclic nucleic acid (BNA)
ccagucgguaagu

SEQ ID NO: 5140 - RNA, 20 nt, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (7)..(7): 5-methyl
  misc_feature (16)..(16): 5-methyl
  misc_feature (20)..(20): 5-methyl
gccagucgguaaguucuguc

SEQ ID NO: 5141 - RNA, 19 nt, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (7)..(7): 5-methyl
  misc_feature (16)..(16): 5-methyl
gccagucgguaaguucugu

SEQ ID NO: 5142 - RNA, 18 nt, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (7)..(7): 5-methyl
  misc_feature (16)..(16): 5-methyl
gccagucgguaaguucug

SEQ ID NO: 5143 - RNA, 17 nt, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (7)..(7): 5-methyl
  misc_feature (16)..(16): 5-methyl
gccagucgguaaguucu

SEQ ID NO: 5144 - RNA, 16 nt, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (7)..(7): 5-methyl
  misc_feature (16)..(16): 5-methyl
gccagucgguaaguuc

SEQ ID NO: 5145 - RNA, 15 nt, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (7)..(7): 5-methyl
gccagucgguaaguu

SEQ ID NO: 5146 - RNA, 14 nt, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (7)..(7): 5-methyl
gccagucgguaagu

SEQ ID NO: 5147 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 5148 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 5149 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (14)..(14): 5-methyl
tcaaggaagauggcau

SEQ ID NO: 5150 - RNA, 15 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (14)..(14): 5-methyl
gaagauggcauuucu

SEQ ID NO: 5151 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucua

SEQ ID NO: 5152 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuc

SEQ ID NO: 5153 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (14)..(14): 5-methyl
tcaaggaagauggcauuu

SEQ ID NO: 5154 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (14)..(14): 5-methyl
tcaaggaagauggcauu

SEQ ID NO: 5155 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (14)..(14): 5-methyl
tcaaggaagauggca

SEQ ID NO: 5156 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (14)..(14): 5-methyl
tcaaggaagauggc

SEQ ID NO: 5157 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
tcaaggaagaugg

SEQ ID NO: 5158 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
tcaaggaagaug

SEQ ID NO: 5159 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
tcaaggaagau

SEQ ID NO: 5160 - DNA, 10 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
tcaaggaaga

SEQ ID NO: 5161 - DNA, 9 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
tcaaggaag

SEQ ID NO: 5162 - RNA, 21 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(2): bicyclic nucleic acid (BNA)
caaggaagauggcauuucuag

SEQ ID NO: 5163 - RNA, 20 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(2): bicyclic nucleic acid (BNA)
caaggaagauggcauuucua

SEQ ID NO: 5164 - RNA, 19 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(2): bicyclic nucleic acid (BNA)
caaggaagauggcauuucu

SEQ ID NO: 5165 - RNA, 18 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(2): bicyclic nucleic acid (BNA)
caaggaagauggcauuuc

SEQ ID NO: 5166 - RNA, 17 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(2): bicyclic nucleic acid (BNA)
caaggaagauggcauuu

SEQ ID NO: 5167 - RNA, 16 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(2): bicyclic nucleic acid (BNA)
caaggaagauggcauu

SEQ ID NO: 5168 - RNA, 15 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(2): bicyclic nucleic acid (BNA)
caaggaagauggcau

SEQ ID NO: 5169 - RNA, 14 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(2): bicyclic nucleic acid (BNA)
caaggaagauggca

SEQ ID NO: 5170 - RNA, 13 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(2): bicyclic nucleic acid (BNA)
caaggaagauggc

SEQ ID NO: 5171 - RNA, 12 nt, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
caaggaagaugg

SEQ ID NO: 5172 - RNA, 11 nt, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
caaggaagaug

SEQ ID NO: 5173 - RNA, 10 nt, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
caaggaagau

SEQ ID NO: 5174 - RNA, 9 nt, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
caaggaaga

SEQ ID NO: 5175 - RNA, 8 nt, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
caaggaag

SEQ ID NO: 5176 - RNA, 20 nt, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
  misc_feature (17)..(17): 5-methyl
aaggaagauggcauuucuag

SEQ ID NO: 5177 - RNA, 19 nt, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
  misc_feature (17)..(17): 5-methyl
aaggaagauggcauuucua

SEQ ID NO: 5178 - RNA, 18 nt, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
  misc_feature (17)..(17): 5-methyl
aaggaagauggcauuucu

SEQ ID NO: 5179 - RNA, 17 nt, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
  misc_feature (17)..(17): 5-methyl
aaggaagauggcauuuc

SEQ ID NO: 5180 - RNA, 16 nt, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
aaggaagauggcauuu

SEQ ID NO: 5181 - RNA, 15 nt, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
aaggaagauggcauu

SEQ ID NO: 5182 - RNA, 14 nt, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
aaggaagauggcau

SEQ ID NO: 5183 - RNA, 13 nt, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
aaggaagauggca

SEQ ID NO: 5184 - RNA, 12 nt, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
aaggaagauggc

SEQ ID NO: 5185 - RNA, 19 nt, Artificial Sequence
  Description of Artificial Sequence: Synthetic Antisense oligonucleotide
  misc_feature (1)..(2): bicyclic nucleic acid (BNA)
  misc_feature (11)..(11): 5-methyl
  misc_feature (16)..(16): 5-methyl
aggaagauggcauuucuag

SEQ ID NO: 5186 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): 5-methyl
  misc_feature (16)..(16): 5-methyl
aggaagauggcauuucua

SEQ ID NO: 5187 - RNA, 17 nt, Artificial Sequence
  Description of Artificial Sequence: Synthetic Antisense oligonucleotide
  misc_feature (1)..(2): bicyclic nucleic acid (BNA)
  misc_feature (11)..(11): 5-methyl
  misc_feature (16)..(16): 5-methyl
aggaagauggcauuucu

SEQ ID NO: 5188 - RNA, 16 nt, Artificial Sequence
  Description of Artificial Sequence: Synthetic Antisense oligonucleotide
  misc_feature (1)..(2): bicyclic nucleic acid (BNA)
  misc_feature (11)..(11): 5-methyl
  misc_feature (16)..(16): 5-methyl
aggaagauggcauuuc

SEQ ID NO: 5189 - RNA, 15 nt, Artificial Sequence
  Description of Artificial Sequence: Synthetic Antisense oligonucleotide
  misc_feature (1)..(2): bicyclic nucleic acid (BNA)
  misc_feature (11)..(11): 5-methyl
aggaagauggcauuu

SEQ ID NO: 5190 - RNA, 14 nt, Artificial Sequence
  Description of Artificial Sequence: Synthetic Antisense oligonucleotide
  misc_feature (1)..(2): bicyclic nucleic acid (BNA)
  misc_feature (11)..(11): 5-methyl
aggaagauggcauu

SEQ ID NO: 5191 - RNA, 13 nt, Artificial Sequence
  Description of Artificial Sequence: Synthetic Antisense oligonucleotide
  misc_feature (1)..(2): bicyclic nucleic acid (BNA)
  misc_feature (11)..(11): 5-methyl
aggaagauggcau

SEQ ID NO: 5192 - RNA, 12 nt, Artificial Sequence
  Description of Artificial Sequence: Synthetic Antisense oligonucleotide
  misc_feature (1)..(2): bicyclic nucleic acid (BNA)
  misc_feature (11)..(11): 5-methyl
aggaagauggca

SEQ ID NO: 5193 - RNA, 18 nt, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
  misc_feature (15)..(15): 5-methyl
ggaagauggcauuucuag

SEQ ID NO: 5194 - RNA, 17 nt, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
  misc_feature (15)..(15): 5-methyl
ggaagauggcauuucua

SEQ ID NO: 5195 - RNA, 16 nt, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
  misc_feature (15)..(15): 5-methyl
ggaagauggcauuucu

SEQ ID NO: 5196 - RNA, 15 nt, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
  misc_feature (15)..(15): 5-methyl
ggaagauggcauuuc

SEQ ID NO: 5197 - RNA, 14 nt, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
ggaagauggcauuu

SEQ ID NO: 5198 - RNA, 13 nt, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
ggaagauggcauu

SEQ ID NO: 5199 - RNA, 12 nt, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
ggaagauggcau

SEQ ID NO: 5200 - RNA, 11 nt, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
ggaagauggca

SEQ ID NO: 5201 - RNA, 10 nt, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
ggaagauggc

SEQ ID NO: 5202 - RNA, 17 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (14)..(14): 5-methyl
gaagauggcauuucuag

SEQ ID NO: 5203 - RNA, 16 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (14)..(14): 5-methyl
gaagauggcauuucua

SEQ ID NO: 5204 - RNA, 14 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (14)..(14): 5-methyl
gaagauggcauuuc

SEQ ID NO: 5205 - RNA, 13 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
gaagauggcauuu

SEQ ID NO: 5206 - RNA, 12 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
gaagauggcauu

SEQ ID NO: 5207 - RNA, 11 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
gaagauggcau

SEQ ID NO: 5208 - RNA, 10 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
gaagauggca

SEQ ID NO: 5209 - RNA, 9 nt, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
gaagauggc

SEQ ID NO: 5210 - RNA, 16 nt, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
  misc_feature (13)..(13): 5-methyl
aagauggcauuucuag

SEQ ID NO: 5211 - RNA, 15 nt, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
  misc_feature (13)..(13): 5-methyl
aagauggcauuucua

SEQ ID NO: 5212 - RNA, 14 nt, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
  misc_feature (13)..(13): 5-methyl
aagauggcauuucu

SEQ ID NO: 5213 - RNA, 13 nt, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
  misc_feature (13)..(13): 5-methyl
aagauggcauuuc

SEQ ID NO: 5214 - RNA, 12 nt, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
aagauggcauuu

SEQ ID NO: 5215 - RNA, 11 nt, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
aagauggcauu

SEQ ID NO: 5216 - RNA, 10 nt, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
aagauggcau

SEQ ID NO: 5217 - RNA, 9 nt, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
aagauggca

SEQ ID NO: 5218 - RNA, 8 nt, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
aagauggc

SEQ ID NO: 5219 - RNA, 15 nt, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (12)..(12): 5-methyl
agauggcauuucuag

SEQ ID NO: 5220 - RNA, 14 nt, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (12)..(12): 5-methyl
agauggcauuucua

SEQ ID NO: 5221 - RNA, 13 nt, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (12)..(12): 5-methyl
agauggcauuucu

SEQ ID NO: 5222 - RNA, 12 nt, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (12)..(12): 5-methyl
agauggcauuuc

SEQ ID NO: 5223 - RNA, 11 nt, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
agauggcauuu

SEQ ID NO: 5224 - RNA, 10 nt, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
agauggcauu

SEQ ID NO: 5225 - RNA, 9 nt, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
agauggcau

SEQ ID NO: 5226 - RNA, 8 nt, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
agauggca

SEQ ID NO: 5227 - DNA, 30 bp, Artificial Sequence; identical to SEQ ID NO: 2957
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(2): bicyclic nucleic acid (BNA)

SEQ ID NO: 5228 - DNA, 29 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(2): bicyclic nucleic acid (BNA)
ctccaacaucaaggaagauggcauuucua

SEQ ID NO: 5229 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(2): bicyclic nucleic acid (BNA)
ctccaacaucaaggaagauggcauuucu

SEQ ID NO: 5230 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(2): bicyclic nucleic acid (BNA)
ctccaacaucaaggaagauggcauuuc

SEQ ID NO: 5231 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
ctccaacaucaaggaagauggcauuu

SEQ ID NO: 5232 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
ctccaacaucaaggaagauggcauu

SEQ ID NO: 5233 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
ctccaacaucaaggaagauggcau

SEQ ID NO: 5234 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
ctccaacaucaaggaagauggca

SEQ ID NO: 5235 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
ctccaacaucaaggaagauggc

SEQ ID NO: 5236 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
ctccaacaucaaggaagaugg

SEQ ID NO: 5237 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
ctccaacaucaaggaagaug

SEQ ID NO: 5238 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
ctccaacaucaaggaagau

SEQ ID NO: 5239 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
ctccaacaucaaggaaga

SEQ ID NO: 5240 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
ctccaacaucaaggaag

SEQ ID NO: 5241 - DNA, 29 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacaucaaggaagauggcauuucuag

SEQ ID NO: 5242 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacaucaaggaagauggcauuucua

SEQ ID NO: 5243 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacaucaaggaagauggcauuucu

SEQ ID NO: 5244 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacaucaaggaagauggcauuuc

SEQ ID NO: 5245 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggcauuu

SEQ ID NO: 5246 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggcauu

SEQ ID NO: 5247 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggcau

SEQ ID NO: 5248 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggca

SEQ ID NO: 5249 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggc

SEQ ID NO: 5250 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
tccaacaucaaggaagaugg

SEQ ID NO: 5251 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
tccaacaucaaggaagaug

SEQ ID NO: 5252 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
tccaacaucaaggaagau

SEQ ID NO: 5253 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
tccaacaucaaggaaga

SEQ ID NO: 5254 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
tccaacaucaaggaag

SEQ ID NO: 5255 - RNA, 28 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(2): bicyclic nucleic acid (BNA)
ccaacaucaaggaagauggcauuucuag

SEQ ID NO: 5256 - RNA, 27 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(2): bicyclic nucleic acid (BNA)
ccaacaucaaggaagauggcauuucua

SEQ ID NO: 5257 - RNA, 26 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(2): bicyclic nucleic acid (BNA)
ccaacaucaaggaagauggcauuucu

SEQ ID NO: 5258 - RNA, 25 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(2): bicyclic nucleic acid (BNA)
ccaacaucaaggaagauggcauuuc

SEQ ID NO: 5259 - RNA, 24 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
ccaacaucaaggaagauggcauuu

SEQ ID NO: 5260 - RNA, 23 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
ccaacaucaaggaagauggcauu

SEQ ID NO: 5261 - RNA, 22 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
ccaacaucaaggaagauggcau

SEQ ID NO: 5262 - RNA, 21 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
ccaacaucaaggaagauggca

SEQ ID NO: 5263 - RNA, 20 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
ccaacaucaaggaagauggc

SEQ ID NO: 5264 - RNA, 19 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
ccaacaucaaggaagaugg

SEQ ID NO: 5265 - RNA, 18 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
ccaacaucaaggaagaug

SEQ ID NO: 5266 - RNA, 17 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
ccaacaucaaggaagau

SEQ ID NO: 5267 - RNA, 16 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
ccaacaucaaggaaga

SEQ ID NO: 5268 - RNA, 15 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
ccaacaucaaggaag

SEQ ID NO: 5269 - RNA, 27 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(2): bicyclic nucleic acid (BNA)
caacaucaaggaagauggcauuucuag

SEQ ID NO: 5270 - RNA, 26 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(2): bicyclic nucleic acid (BNA)
caacaucaaggaagauggcauuucua

SEQ ID NO: 5271 - RNA, 25 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(2): bicyclic nucleic acid (BNA)
caacaucaaggaagauggcauuucu

SEQ ID NO: 5272 - RNA, 24 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(2): bicyclic nucleic acid (BNA)
caacaucaaggaagauggcauuuc

SEQ ID NO: 5273 - RNA, 23 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
caacaucaaggaagauggcauuu

SEQ ID NO: 5274 - RNA, 22 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
caacaucaaggaagauggcauu

SEQ ID NO: 5275 - RNA, 21 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
caacaucaaggaagauggcau

SEQ ID NO: 5276 - RNA, 20 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
caacaucaaggaagauggca

SEQ ID NO: 5277 - RNA, 19 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
caacaucaaggaagauggc

SEQ ID NO: 5278 - RNA, 18 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
caacaucaaggaagaugg

SEQ ID NO: 5279 - RNA, 17 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
caacaucaaggaagaug

SEQ ID NO: 5280 - RNA, 16 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
caacaucaaggaagau

SEQ ID NO: 5281 - RNA, 15 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
caacaucaaggaaga

SEQ ID NO: 5282 - RNA, 14 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
caacaucaaggaag

SEQ ID NO: 5283 - RNA, 26 nt, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuucuag

SEQ ID NO: 5284 - RNA, 25 nt, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuucua

SEQ ID NO: 5285 - RNA, 24 nt, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuucu

SEQ ID NO: 5286 - RNA, 23 nt, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuuc

SEQ ID NO: 5287 - RNA, 22 nt, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
aacaucaaggaagauggcauuu

SEQ ID NO: 5288 - RNA, 21 nt, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
aacaucaaggaagauggcauu

SEQ ID NO: 5289 - RNA, 20 nt, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
aacaucaaggaagauggcau

SEQ ID NO: 5290 - RNA, 19 nt, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
aacaucaaggaagauggca

SEQ ID NO: 5291 - RNA, 18 nt, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
aacaucaaggaagauggc

SEQ ID NO: 5292 - RNA, 17 nt, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
aacaucaaggaagaugg

SEQ ID NO: 5293 - RNA, 16 nt, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
aacaucaaggaagaug

SEQ ID NO: 5294 - RNA, 15 nt, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
aacaucaaggaagau

SEQ ID NO: 5295 - RNA, 14 nt, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
aacaucaaggaaga

SEQ ID NO: 5296 - RNA, 13 nt, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
aacaucaaggaag

SEQ ID NO: 5297 - RNA, 25 nt, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuucuag

SEQ ID NO: 5298 - RNA, 24 nt, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuucua

SEQ ID NO: 5299 - RNA, 23 nt, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuucu

SEQ ID NO: 5300 - RNA, 22 nt, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuuc

SEQ ID NO: 5301 - RNA, 21 nt, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
acaucaaggaagauggcauuu

SEQ ID NO: 5302 - RNA, 20 nt, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
acaucaaggaagauggcauu

SEQ ID NO: 5303 - RNA, 19 nt, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
acaucaaggaagauggcau

SEQ ID NO: 5304 - RNA, 18 nt, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
acaucaaggaagauggca

SEQ ID NO: 5305 - RNA, 17 nt, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
acaucaaggaagauggc

SEQ ID NO: 5306 - RNA, 16 nt, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
acaucaaggaagaugg

SEQ ID NO: 5307 - RNA, 15 nt, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
acaucaaggaagaug

SEQ ID NO: 5308 - RNA, 14 nt, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
acaucaaggaagau

SEQ ID NO: 5309 - RNA, 13 nt, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
acaucaaggaaga

SEQ ID NO: 5310 - RNA, 12 nt, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
acaucaaggaag

SEQ ID NO: 5311 - RNA, 24 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(2): bicyclic nucleic acid (BNA)
caucaaggaagauggcauuucuag

SEQ ID NO: 5312 - RNA, 23 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(2): bicyclic nucleic acid (BNA)
caucaaggaagauggcauuucua

SEQ ID NO: 5313 - RNA, 22 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(2): bicyclic nucleic acid (BNA)
caucaaggaagauggcauuucu

SEQ ID NO: 5314 - RNA, 21 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(2): bicyclic nucleic acid (BNA)
caucaaggaagauggcauuuc

SEQ ID NO: 5315 - RNA, 20 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
caucaaggaagauggcauuu

SEQ ID NO: 5316 - RNA, 19 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
caucaaggaagauggcauu

SEQ ID NO: 5317 - RNA, 18 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
caucaaggaagauggcau

SEQ ID NO: 5318 - RNA, 17 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
caucaaggaagauggca

SEQ ID NO: 5319 - RNA, 16 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
caucaaggaagauggc

SEQ ID NO: 5320 - RNA, 15 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
caucaaggaagaugg

SEQ ID NO: 5321 - RNA, 14 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
caucaaggaagaug

SEQ ID NO: 5322 - RNA, 13 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
caucaaggaagau

SEQ ID NO: 5323 - RNA, 12 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
caucaaggaaga

SEQ ID NO: 5324 - RNA, 11 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
caucaaggaag

SEQ ID NO: 5325 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (15)..(15): 5-methyl
  misc_feature (20)..(20): 5-methyl
atcaaggaagauggcauuucuag

SEQ ID NO: 5326 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (15)..(15): 5-methyl
  misc_feature (20)..(20): 5-methyl
atcaaggaagauggcauuucua

SEQ ID NO: 5327 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (15)..(15): 5-methyl
  misc_feature (20)..(20): 5-methyl
atcaaggaagauggcauuucu

SEQ ID NO: 5328 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (15)..(15): 5-methyl
  misc_feature (20)..(20): 5-methyl
atcaaggaagauggcauuuc

SEQ ID NO: 5329 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (15)..(15): 5-methyl
atcaaggaagauggcauuu

SEQ ID NO: 5330 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (15)..(15): 5-methyl
atcaaggaagauggcauu

SEQ ID NO: 5331 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (15)..(15): 5-methyl
atcaaggaagauggcau

SEQ ID NO: 5332 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (15)..(15): 5-methyl
atcaaggaagauggca

SEQ ID NO: 5333 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
  misc_feature (15)..(15): 5-methyl
atcaaggaagauggc

SEQ ID NO: 5334 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
atcaaggaagaugg

SEQ ID NO: 5335 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
atcaaggaagaug

SEQ ID NO: 5336 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (3)..(3): 5-methyl
atcaaggaagau

SEQ ID NO: 5337 - DNA, 11 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
atcaaggaaga

SEQ ID NO: 5338 - DNA, 10 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
atcaaggaag

SEQ ID NO: 5339 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (17)..(18): bicyclic nucleic acid (BNA)
gguaaguucuguccaagc

SEQ ID NO: 5340 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (17)..(18): bicyclic nucleic acid (BNA)
guaaguucuguccaagcc

SEQ ID NO: 5341 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (17)..(18): bicyclic nucleic acid (BNA)
agucgguaaguucugucc

SEQ ID NO: 5342 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (17)..(18): bicyclic nucleic acid (BNA)
cuguccaagcccgguuga

SEQ ID NO: 5343 - RNA, 15 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (14)..(15): bicyclic nucleic acid (BNA)
uaaguucuguccaag

SEQ ID NO: 5344 - RNA, 20 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (19)..(20): bicyclic nucleic acid (BNA)
uucuguccaagcccgguuga

SEQ ID NO: 5345 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (7)..(8): 5-methyl
  misc_feature (12)..(14): 5-methyl
  misc_feature (18)..(19): bicyclic nucleic acid (BNA)
uucuguccaagcccggutg

SEQ ID NO: 5346 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (7)..(8): 5-methyl
  misc_feature (12)..(14): 5-methyl
  misc_feature (17)..(18): bicyclic nucleic acid (BNA)
uucuguccaagcccggtt

SEQ ID NO: 5347 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (7)..(8): 5-methyl
  misc_feature (12)..(14): 5-methyl
  misc_feature (16)..(17): bicyclic nucleic acid (BNA)
uucuguccaagcccggt

SEQ ID NO: 5348 - RNA, 16 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (15)..(16): bicyclic nucleic acid (BNA)
uucuguccaagcccgg

SEQ ID NO: 5349 - RNA, 15 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (14)..(15): bicyclic nucleic acid (BNA)
uucuguccaagcccg

SEQ ID NO: 5350 - RNA, 14 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (13)..(14): bicyclic nucleic acid (BNA)
uucuguccaagccc

SEQ ID NO: 5351 - RNA, 13 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(13): 5-methyl
  misc_feature (12)..(13): bicyclic nucleic acid (BNA)
uucuguccaagcc

SEQ ID NO: 5352 - RNA, 12 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(12): 5-methyl
  misc_feature (11)..(12): bicyclic nucleic acid (BNA)
uucuguccaagc

SEQ ID NO: 5353 - RNA, 11 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (10)..(11): bicyclic nucleic acid (BNA)
uucuguccaag

SEQ ID NO: 5354 - RNA, 10 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (9)..(10): bicyclic nucleic acid (BNA)
uucuguccaa

SEQ ID NO: 5355 - RNA, 9 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (8)..(9): bicyclic nucleic acid (BNA)
uucugucca

SEQ ID NO: 5356 - RNA, 8 nt, Artificial Sequence
  Description of Artificial Sequence: Synthetic Antisense oligonucleotide
  misc_feature (3)..(3): 5-methyl
  misc_feature (7)..(8): 5-methyl
  misc_feature (7)..(8): bicyclic nucleic acid (BNA)
uucugucc

SEQ ID NO: 5357 - RNA, 19 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (18)..(19): bicyclic nucleic acid (BNA)
ucuguccaagcccgguuga

SEQ ID NO: 5358 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (6)..(7): 5-methyl
  misc_feature (11)..(13): 5-methyl
  misc_feature (17)..(18): bicyclic nucleic acid (BNA)
ucuguccaagcccggutg

SEQ ID NO: 5359 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (6)..(7): 5-methyl
  misc_feature (11)..(13): 5-methyl
  misc_feature (16)..(17): bicyclic nucleic acid (BNA)
ucuguccaagcccggtt

SEQ ID NO: 5360 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (6)..(7): 5-methyl
  misc_feature (11)..(13): 5-methyl
  misc_feature (15)..(16): bicyclic nucleic acid (BNA)
ucuguccaagcccggt

SEQ ID NO: 5361 - RNA, 15 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (14)..(15): bicyclic nucleic acid (BNA)
ucuguccaagcccgg

SEQ ID NO: 5362 - RNA, 14 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (13)..(14): bicyclic nucleic acid (BNA)
ucuguccaagcccg

SEQ ID NO: 5363 - RNA, 13 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (12)..(13): bicyclic nucleic acid (BNA)
ucuguccaagccc

SEQ ID NO: 5364 - RNA, 12 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(12): 5-methyl
  misc_feature (11)..(12): bicyclic nucleic acid (BNA)
ucuguccaagcc

SEQ ID NO: 5365 - RNA, 11 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(11): 5-methyl
  misc_feature (10)..(11): bicyclic nucleic acid (BNA)
ucuguccaagc

SEQ ID NO: 5366 - RNA, 10 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (9)..(10): bicyclic nucleic acid (BNA)
ucuguccaag

SEQ ID NO: 5367 - RNA, 9 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (8)..(9): bicyclic nucleic acid (BNA)
ucuguccaa

SEQ ID NO: 5368 - RNA, 8 nt, Artificial Sequence
  Description of Artificial Sequence: Synthetic Antisense oligonucleotide
  misc_feature (2)..(2): 5-methyl
  misc_feature (6)..(7): 5-methyl
  misc_feature (7)..(8): bicyclic nucleic acid (BNA)
ucugucca

SEQ ID NO: 5369 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (16)..(17): bicyclic nucleic acid (BNA)
cuguccaagcccggutg

SEQ ID NO: 5370 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (15)..(16): bicyclic nucleic acid (BNA)
cuguccaagcccggtt

SEQ ID NO: 5371 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (14)..(15): bicyclic nucleic acid (BNA)
cuguccaagcccggt

SEQ ID NO: 5372 - RNA, 14 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(14): bicyclic nucleic acid (BNA)
cuguccaagcccgg

SEQ ID NO: 5373 - RNA, 13 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(13): bicyclic nucleic acid (BNA)
cuguccaagcccg

SEQ ID NO: 5374 - RNA, 12 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(12): bicyclic nucleic acid (BNA)
cuguccaagccc

SEQ ID NO: 5375 - RNA, 11 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(11): 5-methyl
  misc_feature (10)..(11): bicyclic nucleic acid (BNA)
cuguccaagcc

SEQ ID NO: 5376 - RNA, 10 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(10): 5-methyl
  misc_feature (9)..(10): bicyclic nucleic acid (BNA)
cuguccaagc

SEQ ID NO: 5377 - RNA, 9 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (8)..(9): bicyclic nucleic acid (BNA)
cuguccaag

SEQ ID NO: 5378 - RNA, 8 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (7)..(8): bicyclic nucleic acid (BNA)
cuguccaa

SEQ ID NO: 5379 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (4)..(4): 5-methyl
  misc_feature (8)..(9): 5-methyl
  misc_feature (13)..(15): 5-methyl
  misc_feature (19)..(20): bicyclic nucleic acid (BNA)
guucuguccaagcccggutg

SEQ ID NO: 5380 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (4)..(4): 5-methyl
  misc_feature (8)..(9): 5-methyl
  misc_feature (13)..(15): 5-methyl
  misc_feature (18)..(19): bicyclic nucleic acid (BNA)
guucuguccaagcccggtt

SEQ ID NO: 5381 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (4)..(4): 5-methyl
  misc_feature (8)..(9): 5-methyl
  misc_feature (13)..(15): 5-methyl
  misc_feature (17)..(18): bicyclic nucleic acid (BNA)
guucuguccaagcccggt

SEQ ID NO: 5382 - RNA, 17 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (16)..(17): bicyclic nucleic acid (BNA)
guucuguccaagcccgg

SEQ ID NO: 5383 - RNA, 16 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (15)..(16): bicyclic nucleic acid (BNA)
guucuguccaagcccg

SEQ ID NO: 5384 - RNA, 15 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (14)..(15): bicyclic nucleic acid (BNA)
guucuguccaagccc

SEQ ID NO: 5385 - RNA, 14 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(14): 5-methyl
  misc_feature (13)..(14): bicyclic nucleic acid (BNA)
guucuguccaagcc

SEQ ID NO: 5386 - RNA, 13 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(13): 5-methyl
  misc_feature (12)..(13): bicyclic nucleic acid (BNA)
guucuguccaagc

SEQ ID NO: 5387 - RNA, 12 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (11)..(12): bicyclic nucleic acid (BNA)
guucuguccaag

SEQ ID NO: 5388 - RNA, 11 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (10)..(11): bicyclic nucleic acid (BNA)
guucuguccaa

SEQ ID NO: 5389 - RNA, 10 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (9)..(10): bicyclic nucleic acid (BNA)
guucugucca

SEQ ID NO: 5390 - RNA, 9 nt, Artificial Sequence
  Description of Artificial Sequence: Synthetic Antisense oligonucleotide
  misc_feature (4)..(4): 5-methyl
  misc_feature (8)..(9): 5-methyl
  misc_feature (8)..(9): bicyclic nucleic acid (BNA)
guucugucc

SEQ ID NO: 5391 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (4)..(4): 5-methyl
  misc_feature (8)..(8): 5-methyl
  misc_feature (7)..(8): bicyclic nucleic acid (BNA)
guucugtc

SEQ ID NO: 5392 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(5): 5-methyl
  misc_feature (9)..(10): 5-methyl
  misc_feature (14)..(16): 5-methyl
  misc_feature (19)..(20): bicyclic nucleic acid (BNA)
aguucuguccaagcccggtt

SEQ ID NO: 5393 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(5): 5-methyl
  misc_feature (9)..(10): 5-methyl
  misc_feature (14)..(16): 5-methyl
  misc_feature (18)..(19): bicyclic nucleic acid (BNA)
aguucuguccaagcccggt

SEQ ID NO: 5394 - RNA, 18 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
  misc_feature (17)..(18): bicyclic nucleic acid (BNA)
aguucuguccaagcccgg

SEQ ID NO: 5395 - RNA, 17 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
  misc_feature (16)..(17): bicyclic nucleic acid (BNA)
aguucuguccaagcccg

SEQ ID NO: 5396 - RNA, 16 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
  misc_feature (15)..(16): bicyclic nucleic acid (BNA)
aguucuguccaagccc

SEQ ID NO: 5397 - RNA, 15 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(15): 5-methyl
  misc_feature (14)..(15): bicyclic nucleic acid (BNA)
aguucuguccaagcc

SEQ ID NO: 5398 - RNA, 14 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(14): 5-methyl
  misc_feature (13)..(14): bicyclic nucleic acid (BNA)
aguucuguccaagc

SEQ ID NO: 5399 - RNA, 13 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (12)..(13): bicyclic nucleic acid (BNA)
aguucuguccaag

SEQ ID NO: 5400 - RNA, 12 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (11)..(12): bicyclic nucleic acid (BNA)
aguucuguccaa

SEQ ID NO: 5401 - RNA, 11 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (10)..(11): bicyclic nucleic acid (BNA)
aguucugucca

SEQ ID NO: 5402 - RNA, 10 nt, Artificial Sequence
  Description of Artificial Sequence: Synthetic Antisense oligonucleotide
  misc_feature (5)..(5): 5-methyl
  misc_feature (9)..(10): 5-methyl
  misc_feature (9)..(10): bicyclic nucleic acid (BNA)
aguucugucc

SEQ ID NO: 5403 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(5): 5-methyl
  misc_feature (9)..(9): 5-methyl
  misc_feature (8)..(9): bicyclic nucleic acid (BNA)
aguucugtc

SEQ ID NO: 5404 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(5): 5-methyl
  misc_feature (7)..(8): bicyclic nucleic acid (BNA)
aguucugt

SEQ ID NO: 5405 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (6)..(6): 5-methyl
  misc_feature (10)..(11): 5-methyl
  misc_feature (15)..(17): 5-methyl
  misc_feature (19)..(20): bicyclic nucleic acid (BNA)
aaguucuguccaagcccggt

SEQ ID NO: 5406 - RNA, 19 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
  misc_feature (18)..(19): bicyclic nucleic acid (BNA)
aaguucuguccaagcccgg

SEQ ID NO: 5407 - RNA, 18 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
  misc_feature (17)..(18): bicyclic nucleic acid (BNA)
aaguucuguccaagcccg

SEQ ID NO: 5408 - RNA, 17 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
  misc_feature (16)..(17): bicyclic nucleic acid (BNA)
aaguucuguccaagccc

SEQ ID NO: 5409 - RNA, 16 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(16): 5-methyl
  misc_feature (15)..(16): bicyclic nucleic acid (BNA)
aaguucuguccaagcc

SEQ ID NO: 5410 - RNA, 15 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(15): 5-methyl
  misc_feature (14)..(15): bicyclic nucleic acid (BNA)
aaguucuguccaagc

SEQ ID NO: 5411 - RNA, 14 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (13)..(14): bicyclic nucleic acid (BNA)
aaguucuguccaag

SEQ ID NO: 5412 - RNA, 13 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (12)..(13): bicyclic nucleic acid (BNA)
aaguucuguccaa

SEQ ID NO: 5413 - RNA, 12 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (11)..(12): bicyclic nucleic acid (BNA)
aaguucugucca

SEQ ID NO: 5414 - RNA, 11 nt, Artificial Sequence
  Description of Artificial Sequence: Synthetic Antisense oligonucleotide
  misc_feature (6)..(6): 5-methyl
  misc_feature (10)..(11): 5-methyl
  misc_feature (10)..(11): bicyclic nucleic acid (BNA)
aaguucugucc

SEQ ID NO: 5415 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (6)..(6): 5-methyl
  misc_feature (10)..(10): 5-methyl
  misc_feature (9)..(10): bicyclic nucleic acid (BNA)
aaguucugtc

SEQ ID NO: 5416 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (6)..(6): 5-methyl
  misc_feature (8)..(9): bicyclic nucleic acid (BNA)
aaguucugt

SEQ ID NO: 5417 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (6)..(6): 5-methyl
  misc_feature (7)..(8): bicyclic nucleic acid (BNA)
aaguuctg

SEQ ID NO: 5418 - RNA, 20 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
  misc_feature (19)..(20): bicyclic nucleic acid (BNA)
uaaguucuguccaagcccgg

SEQ ID NO: 5419 - RNA, 19 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
  misc_feature (18)..(19): bicyclic nucleic acid (BNA)
uaaguucuguccaagcccg

SEQ ID NO: 5420 - RNA, 18 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
  misc_feature (17)..(18): bicyclic nucleic acid (BNA)
uaaguucuguccaagccc

SEQ ID NO: 5421 - RNA, 17 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(17): 5-methyl
  misc_feature (16)..(17): bicyclic nucleic acid (BNA)
uaaguucuguccaagcc

SEQ ID NO: 5422 - RNA, 16 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(16): 5-methyl
  misc_feature (15)..(16): bicyclic nucleic acid (BNA)
uaaguucuguccaagc

SEQ ID NO: 5423 - RNA, 14 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (13)..(14): bicyclic nucleic acid (BNA)
uaaguucuguccaa

SEQ ID NO: 5424 - RNA, 13 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (12)..(13): bicyclic nucleic acid (BNA)
uaaguucugucca

SEQ ID NO: 5425 - RNA, 12 nt, Artificial Sequence
  Description of Artificial Sequence: Synthetic Antisense oligonucleotide
  misc_feature (7)..(7): 5-methyl
  misc_feature (11)..(12): 5-methyl
  misc_feature (11)..(12): bicyclic nucleic acid (BNA)
uaaguucugucc

SEQ ID NO: 5426 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(7): 5-methyl
  misc_feature (11)..(11): 5-methyl
  misc_feature (10)..(11): bicyclic nucleic acid (BNA)
uaaguucugtc

SEQ ID NO: 5427 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(7): 5-methyl
  misc_feature (9)..(10): bicyclic nucleic acid (BNA)
uaaguucugt

SEQ ID NO: 5428 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(7): 5-methyl
  misc_feature (8)..(9): bicyclic nucleic acid (BNA)
uaaguuctg

SEQ ID NO: 5429 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(7): 5-methyl
  misc_feature (7)..(8): bicyclic nucleic acid (BNA)
uaaguuct

SEQ ID NO: 5430 - RNA, 20 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(19): 5-methyl
  misc_feature (19)..(20): bicyclic nucleic acid (BNA)
guaaguucuguccaagcccg

SEQ ID NO: 5431 - RNA, 19 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(19): 5-methyl
  misc_feature (18)..(19): bicyclic nucleic acid (BNA)
guaaguucuguccaagccc

SEQ ID NO: 5432 - RNA, 17 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(17): 5-methyl
  misc_feature (16)..(17): bicyclic nucleic acid (BNA)
guaaguucuguccaagc

SEQ ID NO: 5433 - RNA, 16 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (15)..(16): bicyclic nucleic acid (BNA)
guaaguucuguccaag

SEQ ID NO: 5434 - RNA, 15 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (14)..(15): bicyclic nucleic acid (BNA)
guaaguucuguccaa

SEQ ID NO: 5435 - RNA, 14 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (13)..(14): bicyclic nucleic acid (BNA)
guaaguucugucca

SEQ ID NO: 5436 - RNA, 13 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (12)..(13): bicyclic nucleic acid (BNA)
guaaguucugucc

SEQ ID NO: 5437 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): 5-methyl
  misc_feature (12)..(12): 5-methyl
  misc_feature (11)..(12): bicyclic nucleic acid (BNA)
guaaguucugtc

SEQ ID NO: 5438 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): 5-methyl
  misc_feature (10)..(11): bicyclic nucleic acid (BNA)
guaaguucugt

SEQ ID NO: 5439 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): 5-methyl
  misc_feature (9)..(10): bicyclic nucleic acid (BNA)
guaaguuctg

SEQ ID NO: 5440 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): 5-methyl
  misc_feature (8)..(9): bicyclic nucleic acid (BNA)
guaaguuct

SEQ ID NO: 5441 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(8): bicyclic nucleic acid (BNA)
  misc_feature (8)..(8): 5-methyl
guaagutc

SEQ ID NO: 5442 - RNA, 20 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(20): 5-methyl
  misc_feature (19)..(20): bicyclic nucleic acid (BNA)
gguaaguucuguccaagccc

SEQ ID NO: 5443 - RNA, 19 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(19): 5-methyl
  misc_feature (18)..(19): bicyclic nucleic acid (BNA)
gguaaguucuguccaagcc

SEQ ID NO: 5444 - RNA, 17 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (16)..(17): bicyclic nucleic acid (BNA)
gguaaguucuguccaag

SEQ ID NO: 5445 - RNA, 16 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (15)..(16): bicyclic nucleic acid (BNA)
gguaaguucuguccaa

SEQ ID NO: 5446 - RNA, 15 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (14)..(15): bicyclic nucleic acid (BNA)
gguaaguucugucca

SEQ ID NO: 5447 - RNA, 14 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (13)..(14): bicyclic nucleic acid (BNA)
gguaaguucugucc

SEQ ID NO: 5448 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): 5-methyl
  misc_feature (13)..(13): 5-methyl
  misc_feature (12)..(13): bicyclic nucleic acid (BNA)
gguaaguucugtc

SEQ ID NO: 5449 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): 5-methyl
  misc_feature (11)..(12): bicyclic nucleic acid (BNA)
gguaaguucugt

SEQ ID NO: 5450 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): 5-methyl
  misc_feature (10)..(11): bicyclic nucleic acid (BNA)
gguaaguuctg

SEQ ID NO: 5451 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): 5-methyl
  misc_feature (9)..(10): bicyclic nucleic acid (BNA)
gguaaguuct

SEQ ID NO: 5452 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(9): bicyclic nucleic acid (BNA)
  misc_feature (9)..(9): 5-methyl
gguaagutc

SEQ ID NO: 5453 - RNA, 20 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(20): 5-methyl
  misc_feature (19)..(20): bicyclic nucleic acid (BNA)
cgguaaguucuguccaagcc

SEQ ID NO: 5454 - RNA, 19 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(19): 5-methyl
  misc_feature (18)..(19): bicyclic nucleic acid (BNA)
cgguaaguucuguccaagc

SEQ ID NO: 5455 - RNA, 18 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (17)..(18): bicyclic nucleic acid (BNA)
cgguaaguucuguccaag

SEQ ID NO: 5456 - RNA, 17 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (16)..(17): bicyclic nucleic acid (BNA)
cgguaaguucuguccaa

SEQ ID NO: 5457 - RNA, 16 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (15)..(16): bicyclic nucleic acid (BNA)
cgguaaguucugucca

SEQ ID NO: 5458 - RNA, 15 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (14)..(15): bicyclic nucleic acid (BNA)
cgguaaguucugucc

SEQ ID NO: 5459 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (10)..(10): 5-methyl
  misc_feature (14)..(14): 5-methyl
  misc_feature (13)..(14): bicyclic nucleic acid (BNA)
cgguaaguucugtc

SEQ ID NO: 5460 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (10)..(10): 5-methyl
  misc_feature (12)..(13): bicyclic nucleic acid (BNA)
cgguaaguucugt

SEQ ID NO: 5461 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (10)..(10): 5-methyl
  misc_feature (11)..(12): bicyclic nucleic acid (BNA)
cgguaaguuctg

SEQ ID NO: 5462 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (10)..(10): 5-methyl
  misc_feature (10)..(11): bicyclic nucleic acid (BNA)
cgguaaguuct

SEQ ID NO: 5463 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (10)..(10): 5-methyl
  misc_feature (9)..(10): bicyclic nucleic acid (BNA)
cgguaagutc

SEQ ID NO: 5464 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (8)..(9): bicyclic nucleic acid (BNA)
cgguaagtt

SEQ ID NO: 5465 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (7)..(8): bicyclic nucleic acid (BNA)
cgguaagt

SEQ ID NO: 5466 - RNA, 20 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (20)..(20): 5-methyl
  misc_feature (19)..(20): bicyclic nucleic acid (BNA)
ucgguaaguucuguccaagc

SEQ ID NO: 5467 - RNA, 19 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (18)..(19): bicyclic nucleic acid (BNA)
ucgguaaguucuguccaag

SEQ ID NO: 5468 - RNA, 18 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (17)..(18): bicyclic nucleic acid (BNA)
ucgguaaguucuguccaa

SEQ ID NO: 5469 - RNA, 17 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (16)..(17): bicyclic nucleic acid (BNA)
ucgguaaguucugucca

SEQ ID NO: 5470 - RNA, 16 nt, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (15)..(16): bicyclic nucleic acid (BNA)
ucgguaaguucugucc

SEQ ID NO: 5471 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (11)..(11): 5-methyl
  misc_feature (15)..(15): 5-methyl
  misc_feature (14)..(15): bicyclic nucleic acid (BNA)
ucgguaaguucugtc

SEQ ID NO: 5472 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (11)..(11): 5-methyl
  misc_feature (13)..(14): bicyclic nucleic acid (BNA)
ucgguaaguucugt

SEQ ID NO: 5473 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (11)..(11): 5-methyl
  misc_feature (12)..(13): bicyclic nucleic acid (BNA)
ucgguaaguuctg

SEQ ID NO: 5474 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (11)..(11): 5-methyl
  misc_feature (11)..(12): bicyclic nucleic acid (BNA)
ucgguaaguuct

SEQ ID NO: 5475 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (11)..(11): 5-methyl
  misc_feature (10)..(11): bicyclic nucleic acid (BNA)
ucgguaagutc

SEQ ID NO: 5476 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (9)..(10): bicyclic nucleic acid (BNA)
ucgguaagtt

SEQ ID NO: 5477 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (8)..(9): bicyclic nucleic acid (BNA)
ucgguaagt

SEQ ID NO: 5478 - RNA, 20 nt, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
  misc_feature (19)..(20): bicyclic nucleic acid (BNA)
gucgguaaguucuguccaag

SEQ ID NO: 5479 - RNA, 19 nt, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
  misc_feature (18)..(19): bicyclic nucleic acid (BNA)
gucgguaaguucuguccaa

SEQ ID NO: 5480 - RNA, 18 nt, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
  misc_feature (17)..(18): bicyclic nucleic acid (BNA)
gucgguaaguucugucca

SEQ ID NO: 5481 - RNA, 17 nt, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
  misc_feature (16)..(17): bicyclic nucleic acid (BNA)
gucgguaaguucugucc

SEQ ID NO: 5482 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (12)..(12): 5-methyl
  misc_feature (16)..(16): 5-methyl
  misc_feature (15)..(16): bicyclic nucleic acid (BNA)
gucgguaaguucugtc

SEQ ID NO: 5483 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (12)..(12): 5-methyl
  misc_feature (14)..(15): bicyclic nucleic acid (BNA)
gucgguaaguucugt

SEQ ID NO: 5484 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (12)..(12): 5-methyl
  misc_feature (13)..(14): bicyclic nucleic acid (BNA)
gucgguaaguuctg

SEQ ID NO: 5485 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (12)..(12): 5-methyl
  misc_feature (12)..(13): bicyclic nucleic acid (BNA)
gucgguaaguuct

SEQ ID NO: 5486 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (12)..(12): 5-methyl
  misc_feature (11)..(12): bicyclic nucleic acid (BNA)
gucgguaagutc

SEQ ID NO: 5487 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (10)..(11): bicyclic nucleic acid (BNA)
gucgguaagtt

SEQ ID NO: 5488 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (9)..(10): bicyclic nucleic acid (BNA)
gucgguaagt

SEQ ID NO: 5489 - RNA, 20 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (19)..(20): bicyclic nucleic acid (BNA)
agucgguaaguucuguccaa

SEQ ID NO: 5490 - RNA, 19 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (18)..(19): bicyclic nucleic acid (BNA)
agucgguaaguucugucca

SEQ ID NO: 5491 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (4)..(4): 5-methyl
  misc_feature (13)..(13): 5-methyl
  misc_feature (17)..(17): 5-methyl
  misc_feature (16)..(17): bicyclic nucleic acid (BNA)
agucgguaaguucugtc

SEQ ID NO: 5492 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (4)..(4): 5-methyl
  misc_feature (13)..(13): 5-methyl
  misc_feature (15)..(16): bicyclic nucleic acid (BNA)
agucgguaaguucugt

SEQ ID NO: 5493 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (4)..(4): 5-methyl
  misc_feature (13)..(13): 5-methyl
  misc_feature (14)..(15): bicyclic nucleic acid (BNA)
agucgguaaguuctg

SEQ ID NO: 5494 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (4)..(4): 5-methyl
  misc_feature (13)..(13): 5-methyl
  misc_feature (13)..(14): bicyclic nucleic acid (BNA)
agucgguaaguuct

SEQ ID NO: 5495 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (4)..(4): 5-methyl
  misc_feature (13)..(13): 5-methyl
  misc_feature (12)..(13): bicyclic nucleic acid (BNA)
agucgguaagutc

SEQ ID NO: 5496 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (4)..(4): 5-methyl
  misc_feature (11)..(12): bicyclic nucleic acid (BNA)
agucgguaagtt

SEQ ID NO: 5497 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (4)..(4): 5-methyl
  misc_feature (10)..(11): bicyclic nucleic acid (BNA)
agucgguaagt

SEQ ID NO: 5498 - RNA, 20 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (19)..(20): bicyclic nucleic acid (BNA)
cagucgguaaguucugucca

SEQ ID NO: 5499 - RNA, 19 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (18)..(19): bicyclic nucleic acid (BNA)
cagucgguaaguucugucc

SEQ ID NO: 5500 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (14)..(14): 5-methyl
  misc_feature (18)..(18): 5-methyl
  misc_feature (17)..(18): bicyclic nucleic acid (BNA)
cagucgguaaguucugtc

SEQ ID NO: 5501 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (14)..(14): 5-methyl
  misc_feature (16)..(17): bicyclic nucleic acid (BNA)
cagucgguaaguucugt

SEQ ID NO: 5502 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (14)..(14): 5-methyl
  misc_feature (15)..(16): bicyclic nucleic acid (BNA)
cagucgguaaguuctg

SEQ ID NO: 5503 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (14)..(14): 5-methyl
  misc_feature (14)..(15): bicyclic nucleic acid (BNA)
cagucgguaaguuct

SEQ ID NO: 5504 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (14)..(14): 5-methyl
  misc_feature (13)..(14): bicyclic nucleic acid (BNA)
cagucgguaagutc

SEQ ID NO: 5505 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (12)..(13): bicyclic nucleic acid (BNA)
cagucgguaagtt

SEQ ID NO: 5506 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (11)..(12): bicyclic nucleic acid (BNA)
cagucgguaagt

SEQ ID NO: 5507 - RNA, 20 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(20): 5-methyl
  misc_feature (19)..(20): bicyclic nucleic acid (BNA)
ccagucgguaaguucugucc

SEQ ID NO: 5508 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (15)..(15): 5-methyl
  misc_feature (19)..(19): 5-methyl
  misc_feature (18)..(19): bicyclic nucleic acid (BNA)
ccagucgguaaguucugtc

SEQ ID NO: 5509 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (15)..(15): 5-methyl
  misc_feature (17)..(18): bicyclic nucleic acid (BNA)
ccagucgguaaguucugt

SEQ ID NO: 5510 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (15)..(15): 5-methyl
  misc_feature (16)..(17): bicyclic nucleic acid (BNA)
ccagucgguaaguuctg

SEQ ID NO: 5511 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (15)..(15): 5-methyl
  misc_feature (15)..(16): bicyclic nucleic acid (BNA)
ccagucgguaaguuct

SEQ ID NO: 5512 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (15)..(15): 5-methyl
  misc_feature (14)..(15): bicyclic nucleic acid (BNA)
ccagucgguaagutc

SEQ ID NO: 5513 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (13)..(14): bicyclic nucleic acid (BNA)
ccagucgguaagtt

SEQ ID NO: 5514 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (12)..(13): bicyclic nucleic acid (BNA)
ccagucgguaagt

SEQ ID NO: 5515 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (7)..(7): 5-methyl
  misc_feature (16)..(16): 5-methyl
  misc_feature (20)..(20): 5-methyl
  misc_feature (19)..(20): bicyclic nucleic acid (BNA)
gccagucgguaaguucugtc

SEQ ID NO: 5516 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (7)..(7): 5-methyl
  misc_feature (16)..(16): 5-methyl
  misc_feature (18)..(19): bicyclic nucleic acid (BNA)
gccagucgguaaguucugt

SEQ ID NO: 5517 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (7)..(7): 5-methyl
  misc_feature (16)..(16): 5-methyl
  misc_feature (17)..(18): bicyclic nucleic acid (BNA)
gccagucgguaaguuctg

SEQ ID NO: 5518 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (7)..(7): 5-methyl
  misc_feature (16)..(16): 5-methyl
  misc_feature (16)..(17): bicyclic nucleic acid (BNA)
gccagucgguaaguuct

SEQ ID NO: 5519 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (7)..(7): 5-methyl
  misc_feature (16)..(16): 5-methyl
  misc_feature (15)..(16): bicyclic nucleic acid (BNA)
gccagucgguaagutc

SEQ ID NO: 5520 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (7)..(7): 5-methyl
  misc_feature (14)..(15): bicyclic nucleic acid (BNA)
gccagucgguaagtt

SEQ ID NO: 5521 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (7)..(7): 5-methyl
  misc_feature (13)..(14): bicyclic nucleic acid (BNA)
gccagucgguaagt

SEQ ID NO: 5522 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (19)..(20): bicyclic nucleic acid (BNA)
ucaaggaagauggcauuuct

SEQ ID NO: 5523 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (21)..(22): bicyclic nucleic acid (BNA)
ucaaggaagauggcauuucuag

SEQ ID NO: 5524 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (15)..(16): bicyclic nucleic acid (BNA)
ucaaggaagauggcat

SEQ ID NO: 5525 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): 5-methyl
  misc_feature (14)..(14): 5-methyl
  misc_feature (14)..(15): bicyclic nucleic acid (BNA)
gaagauggcauuuct

SEQ ID NO: 5526 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (20)..(21): bicyclic nucleic acid (BNA)
ucaaggaagauggcauuucta

SEQ ID NO: 5527 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (18)..(19): bicyclic nucleic acid (BNA)
ucaaggaagauggcauutc

SEQ ID NO: 5528 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (17)..(18): bicyclic nucleic acid (BNA)
ucaaggaagauggcautt

SEQ ID NO: 5529 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (16)..(17): bicyclic nucleic acid (BNA)
ucaaggaagauggcatt

SEQ ID NO: 5530 - RNA, 15 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (14)..(15): bicyclic nucleic acid (BNA)
ucaaggaagauggca

SEQ ID NO: 5531 - RNA, 14 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (13)..(14): bicyclic nucleic acid (BNA)
ucaaggaagauggc

SEQ ID NO: 5532 - RNA, 13 nt, Artificial Sequence
  Description of Artificial Sequence: Synthetic Antisense oligonucleotide
  misc_feature (2)..(2): 5-methyl
  misc_feature (12)..(13): bicyclic nucleic acid (BNA)
ucaaggaagaugg

SEQ ID NO: 5533 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (11)..(12): bicyclic nucleic acid (BNA)
ucaaggaagatg

SEQ ID NO: 5534 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (10)..(11): bicyclic nucleic acid (BNA)
ucaaggaagat

SEQ ID NO: 5535 - RNA, 10 nt, Artificial Sequence
  Description of Artificial Sequence: Synthetic Antisense oligonucleotide
  misc_feature (2)..(2): 5-methyl
  misc_feature (9)..(10): bicyclic nucleic acid (BNA)
ucaaggaaga

SEQ ID NO: 5536 - RNA, 9 nt, Artificial Sequence
  Description of Artificial Sequence: Synthetic Antisense oligonucleotide
  misc_feature (2)..(2): 5-methyl
  misc_feature (8)..(9): bicyclic nucleic acid (BNA)
ucaaggaag

SEQ ID NO: 5537 - RNA, 21 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (20)..(21): bicyclic nucleic acid (BNA)
caaggaagauggcauuucuag

SEQ ID NO: 5538 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (18)..(18): 5-methyl
  misc_feature (19)..(20): bicyclic nucleic acid (BNA)
caaggaagauggcauuucta

SEQ ID NO: 5539 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (18)..(18): 5-methyl
  misc_feature (18)..(19): bicyclic nucleic acid (BNA)
caaggaagauggcauuuct

SEQ ID NO: 5540 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (18)..(18): 5-methyl
  misc_feature (17)..(18): bicyclic nucleic acid (BNA)
caaggaagauggcauutc

SEQ ID NO: 5541 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (16)..(17): bicyclic nucleic acid (BNA)
caaggaagauggcautt

SEQ ID NO: 5542 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (15)..(16): bicyclic nucleic acid (BNA)
caaggaagauggcatt

SEQ ID NO: 5543 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (14)..(15): bicyclic nucleic acid (BNA)
caaggaagauggcat

SEQ ID NO: 5544 - RNA, 14 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (13)..(14): bicyclic nucleic acid (BNA)
caaggaagauggca

SEQ ID NO: 5545 - RNA, 13 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (12)..(13): bicyclic nucleic acid (BNA)
caaggaagauggc

SEQ ID NO: 5546 - RNA, 12 nt, Artificial Sequence
  Description of Artificial Sequence: Synthetic Antisense oligonucleotide
  misc_feature (1)..(1): 5-methyl
  misc_feature (11)..(12): bicyclic nucleic acid (BNA)
caaggaagaugg

SEQ ID NO: 5547 - DNA, 11 bp, Artificial Sequence
  Description of Artificial Sequence: Synthetic Antisense oligonucleotide
  misc_feature (1)..(1): 5-methyl
  misc_feature (10)..(11): bicyclic nucleic acid (BNA)
caaggaagatg

SEQ ID NO: 5548 - DNA, 10 bp, Artificial Sequence
  Description of Artificial Sequence: Synthetic Antisense oligonucleotide
  misc_feature (1)..(1): 5-methyl
  misc_feature (9)..(10): bicyclic nucleic acid (BNA)
caaggaagat

SEQ ID NO: 5549 - RNA, 9 nt, Artificial Sequence
  Description of Artificial Sequence: Synthetic Antisense oligonucleotide
  misc_feature (1)..(1): 5-methyl
  misc_feature (8)..(9): bicyclic nucleic acid (BNA)
caaggaaga

SEQ ID NO: 5550 - RNA, 8 nt, Artificial Sequence
  Description of Artificial Sequence: Synthetic Antisense oligonucleotide
  misc_feature (1)..(1): 5-methyl
  misc_feature (7)..(8): bicyclic nucleic acid (BNA)
caaggaag

SEQ ID NO: 5551 - RNA, 20 nt, Artificial Sequence
  Description of Artificial Sequence: Synthetic Antisense oligonucleotide
  misc_feature (12)..(12): 5-methyl
  misc_feature (17)..(17): 5-methyl
  misc_feature (19)..(20): bicyclic nucleic acid (BNA)
aaggaagauggcauuucuag

SEQ ID NO: 5552 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): 5-methyl
  misc_feature (17)..(17): 5-methyl
  misc_feature (18)..(19): bicyclic nucleic acid (BNA)
aaggaagauggcauuucta

SEQ ID NO: 5553 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): 5-methyl
  misc_feature (17)..(17): 5-methyl
  misc_feature (17)..(18): bicyclic nucleic acid (BNA)
aaggaagauggcauuuct

SEQ ID NO: 5554 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): 5-methyl
  misc_feature (17)..(17): 5-methyl
  misc_feature (16)..(17): bicyclic nucleic acid (BNA)
aaggaagauggcauutc

SEQ ID NO: 5555 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): 5-methyl
  misc_feature (15)..(16): bicyclic nucleic acid (BNA)
aaggaagauggcautt

SEQ ID NO: 5556 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): 5-methyl
  misc_feature (14)..(15): bicyclic nucleic acid (BNA)
aaggaagauggcatt

SEQ ID NO: 5557 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): 5-methyl
  misc_feature (13)..(14): bicyclic nucleic acid (BNA)
aaggaagauggcat

SEQ ID NO: 5558 - RNA, 13 nt, Artificial Sequence
  Description of Artificial Sequence: Synthetic Antisense oligonucleotide
  misc_feature (12)..(12): 5-methyl
  misc_feature (12)..(13): bicyclic nucleic acid (BNA)
aaggaagauggca

SEQ ID NO: 5559 - RNA, 12 nt, Artificial Sequence
  Description of Artificial Sequence: Synthetic Antisense oligonucleotide
  misc_feature (11)..(12): bicyclic nucleic acid (BNA)
  misc_feature (12)..(12): 5-methyl
aaggaagauggc

SEQ ID NO: 5560 - RNA, 19 nt, Artificial Sequence
  Description of Artificial Sequence: Synthetic Antisense oligonucleotide
  misc_feature (11)..(11): 5-methyl
  misc_feature (16)..(16): 5-methyl
  misc_feature (18)..(19): bicyclic nucleic acid (BNA)
aggaagauggcauuucuag

SEQ ID NO: 5561 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): 5-methyl
  misc_feature (16)..(16): 5-methyl
  misc_feature (17)..(18): bicyclic nucleic acid (BNA)
aggaagauggcauuucta

SEQ ID NO: 5562 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): 5-methyl
  misc_feature (16)..(16): 5-methyl
  misc_feature (16)..(17): bicyclic nucleic acid (BNA)
aggaagauggcauuuct

SEQ ID NO: 5563 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): 5-methyl
  misc_feature (16)..(16): 5-methyl
  misc_feature (15)..(16): bicyclic nucleic acid (BNA)
aggaagauggcauutc

SEQ ID NO: 5564 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): 5-methyl
  misc_feature (14)..(15): bicyclic nucleic acid (BNA)
aggaagauggcautt

SEQ ID NO: 5565 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): 5-methyl
  misc_feature (13)..(14): bicyclic nucleic acid (BNA)
aggaagauggcatt

SEQ ID NO: 5566 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (11)..(11): 5-methyl
  misc_feature (12)..(13): bicyclic nucleic acid (BNA)
aggaagauggcat

SEQ ID NO: 5567 - RNA, 12 nt, Artificial Sequence
  Description of Artificial Sequence: Synthetic Antisense oligonucleotide
  misc_feature (11)..(11): 5-methyl
  misc_feature (11)..(12): bicyclic nucleic acid (BNA)
aggaagauggca

SEQ ID NO: 5568 - RNA, 18 nt, Artificial Sequence
  Description of Artificial Sequence: Synthetic Antisense oligonucleotide
  misc_feature (10)..(10): 5-methyl
  misc_feature (15)..(15): 5-methyl
  misc_feature (17)..(18): bicyclic nucleic acid (BNA)
ggaagauggcauuucuag

SEQ ID NO: 5569 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(10): 5-methyl
  misc_feature (15)..(15): 5-methyl
  misc_feature (16)..(17): bicyclic nucleic acid (BNA)
ggaagauggcauuucta

SEQ ID NO: 5570 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(10): 5-methyl
  misc_feature (15)..(15): 5-methyl
  misc_feature (15)..(16): bicyclic nucleic acid (BNA)
ggaagauggcauuuct

SEQ ID NO: 5571 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(10): 5-methyl
  misc_feature (15)..(15): 5-methyl
  misc_feature (14)..(15): bicyclic nucleic acid (BNA)
ggaagauggcauutc

SEQ ID NO: 5572 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(10): 5-methyl
  misc_feature (13)..(14): bicyclic nucleic acid (BNA)
ggaagauggcautt

SEQ ID NO: 5573 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(10): 5-methyl
  misc_feature (12)..(13): bicyclic nucleic acid (BNA)
ggaagauggcatt

SEQ ID NO: 5574 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (10)..(10): 5-methyl
  misc_feature (11)..(12): bicyclic nucleic acid (BNA)
ggaagauggcat

SEQ ID NO: 5575 - RNA, 11 nt, Artificial Sequence
  Description of Artificial Sequence: Synthetic Antisense oligonucleotide
  misc_feature (10)..(10): 5-methyl
  misc_feature (10)..(11): bicyclic nucleic acid (BNA)
ggaagauggca

SEQ ID NO: 5576 - RNA, 10 nt, Artificial Sequence
  Description of Artificial Sequence: Synthetic Antisense oligonucleotide
  misc_feature (9)..(10): bicyclic nucleic acid (BNA)
  misc_feature (10)..(10): 5-methyl
ggaagauggc

SEQ ID NO: 5577 - RNA, 17 nt, Artificial Sequence
  Description of Artificial Sequence: Synthetic Antisense oligonucleotide
  misc_feature (9)..(9): 5-methyl
  misc_feature (14)..(14): 5-methyl
  misc_feature (16)..(17): bicyclic nucleic acid (BNA)
gaagauggcauuucuag

SEQ ID NO: 5578 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): 5-methyl
  misc_feature (14)..(14): 5-methyl
  misc_feature (15)..(16): bicyclic nucleic acid (BNA)
gaagauggcauuucta

SEQ ID NO: 5579 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): 5-methyl
  misc_feature (14)..(14): 5-methyl
  misc_feature (13)..(14): bicyclic nucleic acid (BNA)
gaagauggcauutc

SEQ ID NO: 5580 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): 5-methyl
  misc_feature (12)..(13): bicyclic nucleic acid (BNA)
gaagauggcautt

SEQ ID NO: 5581 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): 5-methyl
  misc_feature (11)..(12): bicyclic nucleic acid (BNA)
gaagauggcatt

SEQ ID NO: 5582 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): 5-methyl
  misc_feature (10)..(11): bicyclic nucleic acid (BNA)
gaagauggcat

SEQ ID NO: 5583 - RNA, 10 nt, Artificial Sequence
  Description of Artificial Sequence: Synthetic Antisense oligonucleotide
  misc_feature (9)..(9): 5-methyl
  misc_feature (9)..(10): bicyclic nucleic acid (BNA)
gaagauggca

SEQ ID NO: 5584 - RNA, 9 nt, Artificial Sequence
  Description of Artificial Sequence: Synthetic Antisense oligonucleotide
  misc_feature (8)..(9): bicyclic nucleic acid (BNA)
  misc_feature (9)..(9): 5-methyl
gaagauggc

SEQ ID NO: 5585 - RNA, 16 nt, Artificial Sequence
  Description of Artificial Sequence: Synthetic Antisense oligonucleotide
  misc_feature (8)..(8): 5-methyl
  misc_feature (13)..(13): 5-methyl
  misc_feature (15)..(16): bicyclic nucleic acid (BNA)
aagauggcauuucuag

SEQ ID NO: 5586 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): 5-methyl
  misc_feature (13)..(13): 5-methyl
  misc_feature (14)..(15): bicyclic nucleic acid (BNA)
aagauggcauuucta

SEQ ID NO: 5587 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): 5-methyl
  misc_feature (13)..(13): 5-methyl
  misc_feature (13)..(14): bicyclic nucleic acid (BNA)
aagauggcauuuct

SEQ ID NO: 5588 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): 5-methyl
  misc_feature (13)..(13): 5-methyl
  misc_feature (12)..(13): bicyclic nucleic acid (BNA)
aagauggcauutc

SEQ ID NO: 5589 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): 5-methyl
  misc_feature (11)..(12): bicyclic nucleic acid (BNA)
aagauggcautt

SEQ ID NO: 5590 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): 5-methyl
  misc_feature (10)..(11): bicyclic nucleic acid (BNA)
aagauggcatt

SEQ ID NO: 5591 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (8)..(8): 5-methyl
  misc_feature (9)..(10): bicyclic nucleic acid (BNA)
aagauggcat

SEQ ID NO: 5592 - RNA, 9 nt, Artificial Sequence
  Description of Artificial Sequence: Synthetic Antisense oligonucleotide
  misc_feature (8)..(8): 5-methyl
  misc_feature (8)..(9): bicyclic nucleic acid (BNA)
aagauggca

SEQ ID NO: 5593 - RNA, 8 nt, Artificial Sequence
  Description of Artificial Sequence: Synthetic Antisense oligonucleotide
  misc_feature (7)..(8): bicyclic nucleic acid (BNA)
  misc_feature (8)..(8): 5-methyl
aagauggc

SEQ ID NO: 5594 - RNA, 15 nt, Artificial Sequence
  Description of Artificial Sequence: Synthetic Antisense oligonucleotide
  misc_feature (7)..(7): 5-methyl
  misc_feature (12)..(12): 5-methyl
  misc_feature (14)..(15): bicyclic nucleic acid (BNA)
agauggcauuucuag

SEQ ID NO: 5595 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(7): 5-methyl
  misc_feature (12)..(12): 5-methyl
  misc_feature (13)..(14): bicyclic nucleic acid (BNA)
agauggcauuucta

SEQ ID NO: 5596 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(7): 5-methyl
  misc_feature (12)..(12): 5-methyl
  misc_feature (12)..(13): bicyclic nucleic acid (BNA)
agauggcauuuct

SEQ ID NO: 5597 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(7): 5-methyl
  misc_feature (12)..(12): 5-methyl
  misc_feature (11)..(12): bicyclic nucleic acid (BNA)
agauggcauutc

SEQ ID NO: 5598 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(7): 5-methyl
  misc_feature (10)..(11): bicyclic nucleic acid (BNA)
agauggcautt

SEQ ID NO: 5599 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(7): 5-methyl
  misc_feature (9)..(10): bicyclic nucleic acid (BNA)
agauggcatt

SEQ ID NO: 5600 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (7)..(7): 5-methyl
  misc_feature (8)..(9): bicyclic nucleic acid (BNA)
agauggcat

SEQ ID NO: 5601 - RNA, 8 nt, Artificial Sequence
  Description of Artificial Sequence: Synthetic Antisense oligonucleotide
  misc_feature (7)..(7): 5-methyl
  misc_feature (7)..(8): bicyclic nucleic acid (BNA)
agauggca

SEQ ID NO: 5602 - RNA, 30 nt, Artificial Sequence; identical to SEQ ID NO: 287
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (29)..(30): bicyclic nucleic acid (BNA)

SEQ ID NO: 5603 - DNA, 29 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (28)..(29): bicyclic nucleic acid (BNA)
cuccaacaucaaggaagauggcauuucta

SEQ ID NO: 5604 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (27)..(28): bicyclic nucleic acid (BNA)
cuccaacaucaaggaagauggcauuuct

SEQ ID NO: 5605 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (26)..(27): bicyclic nucleic acid (BNA)
cuccaacaucaaggaagauggcauutc

SEQ ID NO: 5606 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (25)..(26): bicyclic nucleic acid (BNA)
cuccaacaucaaggaagauggcautt

SEQ ID NO: 5607 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (24)..(25): bicyclic nucleic acid (BNA)
cuccaacaucaaggaagauggcatt

SEQ ID NO: 5608 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (23)..(24): bicyclic nucleic acid (BNA)
cuccaacaucaaggaagauggcat

SEQ ID NO: 5609 - RNA, 23 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (22)..(23): bicyclic nucleic acid (BNA)
cuccaacaucaaggaagauggca

SEQ ID NO: 5610 - RNA, 22 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (21)..(22): bicyclic nucleic acid (BNA)
cuccaacaucaaggaagauggc

SEQ ID NO: 5611 - RNA, 21 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (20)..(21): bicyclic nucleic acid (BNA)
cuccaacaucaaggaagaugg

SEQ ID NO: 5612 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (19)..(20): bicyclic nucleic acid (BNA)
cuccaacaucaaggaagatg

SEQ ID NO: 5613 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (18)..(19): bicyclic nucleic acid (BNA)
cuccaacaucaaggaagat

SEQ ID NO: 5614 - RNA, 18 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (17)..(18): bicyclic nucleic acid (BNA)
cuccaacaucaaggaaga

SEQ ID NO: 5615 - RNA, 17 nt, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (16)..(17): bicyclic nucleic acid (BNA)
cuccaacaucaaggaag

SEQ ID NO: 5616 - RNA, 29 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
  misc_feature (28)..(29): bicyclic nucleic acid (BNA)
uccaacaucaaggaagauggcauuucuag

SEQ ID NO: 5617 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
  misc_feature (27)..(28): bicyclic nucleic acid (BNA)
uccaacaucaaggaagauggcauuucta

SEQ ID NO: 5618 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
  misc_feature (26)..(27): bicyclic nucleic acid (BNA)
uccaacaucaaggaagauggcauuuct

SEQ ID NO: 5619 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
  misc_feature (25)..(26): bicyclic nucleic acid (BNA)
uccaacaucaaggaagauggcauutc

SEQ ID NO: 5620 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (24)..(25): bicyclic nucleic acid (BNA)
uccaacaucaaggaagauggcautt

SEQ ID NO: 5621 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (23)..(24): bicyclic nucleic acid (BNA)
uccaacaucaaggaagauggcatt

SEQ ID NO: 5622 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (22)..(23): bicyclic nucleic acid (BNA)
uccaacaucaaggaagauggcat

SEQ ID NO: 5623 - RNA, 22 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (21)..(22): bicyclic nucleic acid (BNA)
uccaacaucaaggaagauggca

SEQ ID NO: 5624 - RNA, 21 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (20)..(21): bicyclic nucleic acid (BNA)
uccaacaucaaggaagauggc

SEQ ID NO: 5625 - RNA, 20 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (19)..(20): bicyclic nucleic acid (BNA)
uccaacaucaaggaagaugg

SEQ ID NO: 5626 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (6)..(6): 5-methyl
  misc_feature (9)..(9): 5-methyl
  misc_feature (18)..(19): bicyclic nucleic acid (BNA)
uccaacaucaaggaagatg

SEQ ID NO: 5627 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(3): 5-methyl
  misc_feature (6)..(6): 5-methyl
  misc_feature (9)..(9): 5-methyl
  misc_feature (17)..(18): bicyclic nucleic acid (BNA)
uccaacaucaaggaagat

SEQ ID NO: 5628 - RNA, 17 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (16)..(17): bicyclic nucleic acid (BNA)
uccaacaucaaggaaga

SEQ ID NO: 5629 - RNA, 16 nt, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (15)..(16): bicyclic nucleic acid (BNA)
uccaacaucaaggaag

SEQ ID NO: 5630 - RNA, 28 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (27)..(28): bicyclic nucleic acid (BNA)
ccaacaucaaggaagauggcauuucuag

SEQ ID NO: 5631 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (26)..(27): bicyclic nucleic acid (BNA)
ccaacaucaaggaagauggcauuucta

SEQ ID NO: 5632 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (25)..(26): bicyclic nucleic acid (BNA)
ccaacaucaaggaagauggcauuuct

SEQ ID NO: 5633 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (24)..(25): bicyclic nucleic acid (BNA)
ccaacaucaaggaagauggcauutc

SEQ ID NO: 5634 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (23)..(24): bicyclic nucleic acid (BNA)
ccaacaucaaggaagauggcautt

SEQ ID NO: 5635 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (22)..(23): bicyclic nucleic acid (BNA)
ccaacaucaaggaagauggcatt

SEQ ID NO: 5636 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (21)..(22): bicyclic nucleic acid (BNA)
ccaacaucaaggaagauggcat

SEQ ID NO: 5637 - RNA, 21 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (20)..(21): bicyclic nucleic acid (BNA)
ccaacaucaaggaagauggca

SEQ ID NO: 5638 - RNA, 20 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (19)..(20): bicyclic nucleic acid (BNA)
ccaacaucaaggaagauggc

SEQ ID NO: 5639 - RNA, 19 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (18)..(19): bicyclic nucleic acid (BNA)
ccaacaucaaggaagaugg

SEQ ID NO: 5640 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (17)..(18): bicyclic nucleic acid (BNA)
ccaacaucaaggaagatg

SEQ ID NO: 5641 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (16)..(17): bicyclic nucleic acid (BNA)
ccaacaucaaggaagat

SEQ ID NO: 5642 - RNA, 16 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (15)..(16): bicyclic nucleic acid (BNA)
ccaacaucaaggaaga

SEQ ID NO: 5643 - RNA, 15 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (14)..(15): bicyclic nucleic acid (BNA)
ccaacaucaaggaag

SEQ ID NO: 5644 - RNA, 27 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (26)..(27): bicyclic nucleic acid (BNA)
caacaucaaggaagauggcauuucuag

SEQ ID NO: 5645 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (25)..(26): bicyclic nucleic acid (BNA)
caacaucaaggaagauggcauuucta

SEQ ID NO: 5646 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (24)..(25): bicyclic nucleic acid (BNA)
caacaucaaggaagauggcauuuct

SEQ ID NO: 5647 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (23)..(24): bicyclic nucleic acid (BNA)
caacaucaaggaagauggcauutc

SEQ ID NO: 5648 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (22)..(23): bicyclic nucleic acid (BNA)
caacaucaaggaagauggcautt

SEQ ID NO: 5649 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (21)..(22): bicyclic nucleic acid (BNA)
caacaucaaggaagauggcatt

SEQ ID NO: 5650 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (20)..(21): bicyclic nucleic acid (BNA)
caacaucaaggaagauggcat

SEQ ID NO: 5651 - RNA, 20 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (19)..(20): bicyclic nucleic acid (BNA)
caacaucaaggaagauggca

SEQ ID NO: 5652 - RNA, 19 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (18)..(19): bicyclic nucleic acid (BNA)
caacaucaaggaagauggc

SEQ ID NO: 5653 - RNA, 18 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (17)..(18): bicyclic nucleic acid (BNA)
caacaucaaggaagaugg

SEQ ID NO: 5654 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (16)..(17): bicyclic nucleic acid (BNA)
caacaucaaggaagatg

SEQ ID NO: 5655 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (15)..(16): bicyclic nucleic acid (BNA)
caacaucaaggaagat

SEQ ID NO: 5656 - RNA, 15 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (14)..(15): bicyclic nucleic acid (BNA)
caacaucaaggaaga

SEQ ID NO: 5657 - RNA, 14 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (13)..(14): bicyclic nucleic acid (BNA)
caacaucaaggaag

SEQ ID NO: 5658 - RNA, 26 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
  misc_feature (25)..(26): bicyclic nucleic acid (BNA)
aacaucaaggaagauggcauuucuag

SEQ ID NO: 5659 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
  misc_feature (24)..(25): bicyclic nucleic acid (BNA)
aacaucaaggaagauggcauuucta

SEQ ID NO: 5660 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
  misc_feature (23)..(24): bicyclic nucleic acid (BNA)
aacaucaaggaagauggcauuuct

SEQ ID NO: 5661 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
  misc_feature (22)..(23): bicyclic nucleic acid (BNA)
aacaucaaggaagauggcauutc

SEQ ID NO: 5662 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (6)..(6): 5-methyl
  misc_feature (18)..(18): 5-methyl
  misc_feature (21)..(22): bicyclic nucleic acid (BNA)
aacaucaaggaagauggcautt

SEQ ID NO: 5663 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (6)..(6): 5-methyl
  misc_feature (18)..(18): 5-methyl
  misc_feature (20)..(21): bicyclic nucleic acid (BNA)
aacaucaaggaagauggcatt

SEQ ID NO: 5664 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (6)..(6): 5-methyl
  misc_feature (18)..(18): 5-methyl
  misc_feature (19)..(20): bicyclic nucleic acid (BNA)
aacaucaaggaagauggcat

SEQ ID NO: 5665 - RNA, 19 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (18)..(19): bicyclic nucleic acid (BNA)
aacaucaaggaagauggca

SEQ ID NO: 5666 - RNA, 18 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (17)..(18): bicyclic nucleic acid (BNA)
aacaucaaggaagauggc

SEQ ID NO: 5667 - RNA, 17 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (16)..(17): bicyclic nucleic acid (BNA)
aacaucaaggaagaugg

SEQ ID NO: 5668 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (6)..(6): 5-methyl
  misc_feature (15)..(16): bicyclic nucleic acid (BNA)
aacaucaaggaagatg

SEQ ID NO: 5669 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (6)..(6): 5-methyl
  misc_feature (14)..(15): bicyclic nucleic acid (BNA)
aacaucaaggaagat

SEQ ID NO: 5670 - RNA, 14 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (13)..(14): bicyclic nucleic acid (BNA)
aacaucaaggaaga

SEQ ID NO: 5671 - RNA, 13 nt, Artificial Sequence
  Description of Artificial Sequence: Synthetic Antisense oligonucleotide
  misc_feature (3)..(3): 5-methyl
  misc_feature (6)..(6): 5-methyl
  misc_feature (12)..(13): bicyclic nucleic acid (BNA)
aacaucaaggaag

SEQ ID NO: 5672 - RNA, 25 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
  misc_feature (24)..(25): bicyclic nucleic acid (BNA)
acaucaaggaagauggcauuucuag

SEQ ID NO: 5673 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
  misc_feature (23)..(24): bicyclic nucleic acid (BNA)
acaucaaggaagauggcauuucta

SEQ ID NO: 5674 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
  misc_feature (22)..(23): bicyclic nucleic acid (BNA)
acaucaaggaagauggcauuuct

SEQ ID NO: 5675 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
  misc_feature (21)..(22): bicyclic nucleic acid (BNA)
acaucaaggaagauggcauutc

SEQ ID NO: 5676 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (5)..(5): 5-methyl
  misc_feature (17)..(17): 5-methyl
  misc_feature (20)..(21): bicyclic nucleic acid (BNA)
acaucaaggaagauggcautt

SEQ ID NO: 5677 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (5)..(5): 5-methyl
  misc_feature (17)..(17): 5-methyl
  misc_feature (19)..(20): bicyclic nucleic acid (BNA)
acaucaaggaagauggcatt

SEQ ID NO: 5678 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (5)..(5): 5-methyl
  misc_feature (17)..(17): 5-methyl
  misc_feature (18)..(19): bicyclic nucleic acid (BNA)
acaucaaggaagauggcat

SEQ ID NO: 5679 - RNA, 18 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (17)..(18): bicyclic nucleic acid (BNA)
acaucaaggaagauggca

SEQ ID NO: 5680 - RNA, 17 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (16)..(17): bicyclic nucleic acid (BNA)
acaucaaggaagauggc

SEQ ID NO: 5681 - RNA, 16 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (15)..(16): bicyclic nucleic acid (BNA)
acaucaaggaagaugg

SEQ ID NO: 5682 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (5)..(5): 5-methyl
  misc_feature (14)..(15): bicyclic nucleic acid (BNA)
acaucaaggaagatg

SEQ ID NO: 5683 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (5)..(5): 5-methyl
  misc_feature (13)..(14): bicyclic nucleic acid (BNA)
acaucaaggaagat

SEQ ID NO: 5684 - RNA, 13 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (12)..(13): bicyclic nucleic acid (BNA)
acaucaaggaaga

SEQ ID NO: 5685 - RNA, 12 nt, Artificial Sequence
  Description of Artificial Sequence: Synthetic Antisense oligonucleotide
  misc_feature (2)..(2): 5-methyl
  misc_feature (5)..(5): 5-methyl
  misc_feature (11)..(12): bicyclic nucleic acid (BNA)
acaucaaggaag

SEQ ID NO: 5686 - RNA, 24 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (23)..(24): bicyclic nucleic acid (BNA)
caucaaggaagauggcauuucuag

SEQ ID NO: 5687 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (22)..(23): bicyclic nucleic acid (BNA)
caucaaggaagauggcauuucta

SEQ ID NO: 5688 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (21)..(22): bicyclic nucleic acid (BNA)
caucaaggaagauggcauuuct

SEQ ID NO: 5689 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (20)..(21): bicyclic nucleic acid (BNA)
caucaaggaagauggcauutc

SEQ ID NO: 5690 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (19)..(20): bicyclic nucleic acid (BNA)
caucaaggaagauggcautt

SEQ ID NO: 5691 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (18)..(19): bicyclic nucleic acid (BNA)
caucaaggaagauggcatt

SEQ ID NO: 5692 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (17)..(18): bicyclic nucleic acid (BNA)
caucaaggaagauggcat

SEQ ID NO: 5693 - RNA, 17 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (16)..(17): bicyclic nucleic acid (BNA)
caucaaggaagauggca

SEQ ID NO: 5694 - RNA, 16 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (15)..(16): bicyclic nucleic acid (BNA)
caucaaggaagauggc

SEQ ID NO: 5695 - RNA, 15 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (14)..(15): bicyclic nucleic acid (BNA)
caucaaggaagaugg

SEQ ID NO: 5696 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (13)..(14): bicyclic nucleic acid (BNA)
caucaaggaagatg

SEQ ID NO: 5697 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (12)..(13): bicyclic nucleic acid (BNA)
caucaaggaagat

SEQ ID NO: 5698 - RNA, 12 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (11)..(12): bicyclic nucleic acid (BNA)
caucaaggaaga

SEQ ID NO: 5699 - RNA, 11 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (10)..(11): bicyclic nucleic acid (BNA)
caucaaggaag

SEQ ID NO: 5700 - RNA, 23 nt, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
  misc_feature (22)..(23): bicyclic nucleic acid (BNA)
aucaaggaagauggcauuucuag

SEQ ID NO: 5701 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (15)..(15): 5-methyl
  misc_feature (20)..(20): 5-methyl
  misc_feature (21)..(22): bicyclic nucleic acid (BNA)
aucaaggaagauggcauuucta

SEQ ID NO: 5702 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (15)..(15): 5-methyl
  misc_feature (20)..(20): 5-methyl
  misc_feature (20)..(21): bicyclic nucleic acid (BNA)
aucaaggaagauggcauuuct

SEQ ID NO: 5703 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (15)..(15): 5-methyl
  misc_feature (20)..(20): 5-methyl
  misc_feature (19)..(20): bicyclic nucleic acid (BNA)
aucaaggaagauggcauutc

SEQ ID NO: 5704 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (15)..(15): 5-methyl
  misc_feature (18)..(19): bicyclic nucleic acid (BNA)
aucaaggaagauggcautt

SEQ ID NO: 5705 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (15)..(15): 5-methyl
  misc_feature (17)..(18): bicyclic nucleic acid (BNA)
aucaaggaagauggcatt

SEQ ID NO: 5706 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (15)..(15): 5-methyl
  misc_feature (16)..(17): bicyclic nucleic acid (BNA)
aucaaggaagauggcat

SEQ ID NO: 5707 - RNA, 16 nt, Artificial Sequence
  Description of Artificial Sequence: Synthetic Antisense oligonucleotide
  misc_feature (3)..(3): 5-methyl
  misc_feature (15)..(15): 5-methyl
  misc_feature (15)..(16): bicyclic nucleic acid (BNA)
aucaaggaagauggca

SEQ ID NO: 5708 - RNA, 15 nt, Artificial Sequence
  Description of Artificial Sequence: Synthetic Antisense oligonucleotide
  misc_feature (3)..(3): 5-methyl
  misc_feature (15)..(15): 5-methyl
  misc_feature (14)..(15): bicyclic nucleic acid (BNA)
aucaaggaagauggc

SEQ ID NO: 5709 - RNA, 14 nt, Artificial Sequence
  Description of Artificial Sequence: Synthetic Antisense oligonucleotide
  misc_feature (3)..(3): 5-methyl
  misc_feature (13)..(14): bicyclic nucleic acid (BNA)
aucaaggaagaugg

SEQ ID NO: 5710 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (12)..(13): bicyclic nucleic acid (BNA)
aucaaggaagatg

SEQ ID NO: 5711 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (3)..(3): 5-methyl
  misc_feature (11)..(12): bicyclic nucleic acid (BNA)
aucaaggaagat

SEQ ID NO: 5712 - RNA, 11 nt, Artificial Sequence
  Description of Artificial Sequence: Synthetic Antisense oligonucleotide
  misc_feature (3)..(3): 5-methyl
  misc_feature (10)..(11): bicyclic nucleic acid (BNA)
aucaaggaaga

SEQ ID NO: 5713 - RNA, 10 nt, Artificial Sequence
  Description of Artificial Sequence: Synthetic Antisense oligonucleotide
  misc_feature (3)..(3): 5-methyl
  misc_feature (9)..(10): bicyclic nucleic acid (BNA)
aucaaggaag

SEQ ID NO: 5714 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 5715 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 5716 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 5717 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (17)..(18): bicyclic nucleic acid (BNA)
ctguccaagcccgguuga

SEQ ID NO: 5718 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (7)..(7): 5-methyl
  misc_feature (11)..(12): 5-methyl
taaguucuguccaag

SEQ ID NO: 5719 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
  misc_feature (3)..(3): 5-methyl
  misc_feature (7)..(8): 5-methyl
  misc_feature (12)..(14): 5-methyl
ttcuguccaagcccgguuga

SEQ ID NO: 5720 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
  misc_feature (3)..(3): 5-methyl
  misc_feature (7)..(8): 5-methyl
  misc_feature (12)..(14): 5-methyl
ttcuguccaagcccggutg

SEQ ID NO: 5721 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
  misc_feature (3)..(3): 5-methyl
  misc_feature (7)..(8): 5-methyl
  misc_feature (12)..(14): 5-methyl
ttcuguccaagcccggtt

SEQ ID NO: 5722 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
  misc_feature (3)..(3): 5-methyl
  misc_feature (7)..(8): 5-methyl
  misc_feature (12)..(14): 5-methyl
ttcuguccaagcccggt

SEQ ID NO: 5723 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
  misc_feature (3)..(3): 5-methyl
  misc_feature (7)..(8): 5-methyl
  misc_feature (12)..(14): 5-methyl
ttcuguccaagcccgg

SEQ ID NO: 5724 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (3)..(3): 5-methyl
  misc_feature (7)..(8): 5-methyl
  misc_feature (12)..(14): 5-methyl
ttcuguccaagcccg

SEQ ID NO: 5725 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (3)..(3): 5-methyl
  misc_feature (7)..(8): 5-methyl
  misc_feature (12)..(14): 5-methyl
ttcuguccaagccc

SEQ ID NO: 5726 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (3)..(3): 5-methyl
  misc_feature (7)..(8): 5-methyl
  misc_feature (12)..(13): 5-methyl
ttcuguccaagcc

SEQ ID NO: 5727 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
  misc_feature (3)..(3): 5-methyl
  misc_feature (7)..(8): 5-methyl
  misc_feature (12)..(12): 5-methyl
ttcuguccaagc

SEQ ID NO: 5728 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
  misc_feature (3)..(3): 5-methyl
  misc_feature (7)..(8): 5-methyl
ttcuguccaag

SEQ ID NO: 5729 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
  misc_feature (3)..(3): 5-methyl
  misc_feature (7)..(8): 5-methyl
ttcuguccaa

SEQ ID NO: 5730 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
  misc_feature (3)..(3): 5-methyl
  misc_feature (7)..(8): 5-methyl
ttcugucca

SEQ ID NO: 5731 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(8): bicyclic nucleic acid (BNA)
  misc_feature (3)..(3): 5-methyl
  misc_feature (7)..(8): 5-methyl
ttcugucc

SEQ ID NO: 5732 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
  misc_feature (2)..(2): 5-methyl
  misc_feature (6)..(7): 5-methyl
  misc_feature (11)..(13): 5-methyl
tcuguccaagcccgguuga

SEQ ID NO: 5733 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
  misc_feature (2)..(2): 5-methyl
  misc_feature (6)..(7): 5-methyl
  misc_feature (11)..(13): 5-methyl
tcuguccaagcccggutg

SEQ ID NO: 5734 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
  misc_feature (2)..(2): 5-methyl
  misc_feature (6)..(7): 5-methyl
  misc_feature (11)..(13): 5-methyl
tcuguccaagcccggtt

SEQ ID NO: 5735 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
  misc_feature (2)..(2): 5-methyl
  misc_feature (6)..(7): 5-methyl
  misc_feature (11)..(13): 5-methyl
tcuguccaagcccggt

SEQ ID NO: 5736 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (2)..(2): 5-methyl
  misc_feature (6)..(7): 5-methyl
  misc_feature (11)..(13): 5-methyl
tcuguccaagcccgg

SEQ ID NO: 5737 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (2)..(2): 5-methyl
  misc_feature (6)..(7): 5-methyl
  misc_feature (11)..(13): 5-methyl
tcuguccaagcccg

SEQ ID NO: 5738 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (2)..(2): 5-methyl
  misc_feature (6)..(7): 5-methyl
  misc_feature (11)..(13): 5-methyl
tcuguccaagccc

SEQ ID NO: 5739 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
  misc_feature (2)..(2): 5-methyl
  misc_feature (6)..(7): 5-methyl
  misc_feature (11)..(12): 5-methyl
tcuguccaagcc

SEQ ID NO: 5740 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
  misc_feature (2)..(2): 5-methyl
  misc_feature (6)..(7): 5-methyl
  misc_feature (11)..(11): 5-methyl
tcuguccaagc

SEQ ID NO: 5741 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
  misc_feature (2)..(2): 5-methyl
  misc_feature (6)..(7): 5-methyl
tcuguccaag

SEQ ID NO: 5742 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
  misc_feature (2)..(2): 5-methyl
  misc_feature (6)..(7): 5-methyl
tcuguccaa

SEQ ID NO: 5743 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(8): bicyclic nucleic acid (BNA)
  misc_feature (2)..(2): 5-methyl
  misc_feature (6)..(7): 5-methyl
tcugucca

SEQ ID NO: 5744 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (16)..(17): bicyclic nucleic acid (BNA)
ctguccaagcccggutg

SEQ ID NO: 5745 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (15)..(16): bicyclic nucleic acid (BNA)
ctguccaagcccggtt

SEQ ID NO: 5746 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (14)..(15): bicyclic nucleic acid (BNA)
ctguccaagcccggt

SEQ ID NO: 5747 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (13)..(14): bicyclic nucleic acid (BNA)
ctguccaagcccgg

SEQ ID NO: 5748 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (12)..(13): bicyclic nucleic acid (BNA)
ctguccaagcccg

SEQ ID NO: 5749 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(12): bicyclic nucleic acid (BNA)
ctguccaagccc

SEQ ID NO: 5750 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(11): 5-methyl
  misc_feature (1)..(2): bicyclic nucleic acid (BNA)
  misc_feature (10)..(11): bicyclic nucleic acid (BNA)
ctguccaagcc

SEQ ID NO: 5751 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(10): 5-methyl
  misc_feature (1)..(2): bicyclic nucleic acid (BNA)
  misc_feature (9)..(10): bicyclic nucleic acid (BNA)
ctguccaagc

SEQ ID NO: 5752 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (1)..(2): bicyclic nucleic acid (BNA)
  misc_feature (8)..(9): bicyclic nucleic acid (BNA)
ctguccaag

SEQ ID NO: 5753 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (1)..(2): bicyclic nucleic acid (BNA)
  misc_feature (7)..(8): bicyclic nucleic acid (BNA)
ctguccaa

SEQ ID NO: 5754 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
  misc_feature (4)..(4): 5-methyl
  misc_feature (8)..(9): 5-methyl
  misc_feature (13)..(15): 5-methyl
gtucuguccaagcccggutg

SEQ ID NO: 5755 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
  misc_feature (4)..(4): 5-methyl
  misc_feature (8)..(9): 5-methyl
  misc_feature (13)..(15): 5-methyl
gtucuguccaagcccggtt

SEQ ID NO: 5756 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
  misc_feature (4)..(4): 5-methyl
  misc_feature (8)..(9): 5-methyl
  misc_feature (13)..(15): 5-methyl
gtucuguccaagcccggt

SEQ ID NO: 5757 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
  misc_feature (4)..(4): 5-methyl
  misc_feature (8)..(9): 5-methyl
  misc_feature (13)..(15): 5-methyl
gtucuguccaagcccgg

SEQ ID NO: 5758 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
  misc_feature (4)..(4): 5-methyl
  misc_feature (8)..(9): 5-methyl
  misc_feature (13)..(15): 5-methyl
gtucuguccaagcccg

SEQ ID NO: 5759 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (4)..(4): 5-methyl
  misc_feature (8)..(9): 5-methyl
  misc_feature (13)..(15): 5-methyl
gtucuguccaagccc

SEQ ID NO: 5760 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (4)..(4): 5-methyl
  misc_feature (8)..(9): 5-methyl
  misc_feature (13)..(14): 5-methyl
gtucuguccaagcc

SEQ ID NO: 5761 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (4)..(4): 5-methyl
  misc_feature (8)..(9): 5-methyl
  misc_feature (13)..(13): 5-methyl
gtucuguccaagc

SEQ ID NO: 5762 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
  misc_feature (4)..(4): 5-methyl
  misc_feature (8)..(9): 5-methyl
gtucuguccaag

SEQ ID NO: 5763 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
  misc_feature (4)..(4): 5-methyl
  misc_feature (8)..(9): 5-methyl
gtucuguccaa

SEQ ID NO: 5764 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
  misc_feature (4)..(4): 5-methyl
  misc_feature (8)..(9): 5-methyl
gtucugucca

SEQ ID NO: 5765 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
  misc_feature (4)..(4): 5-methyl
  misc_feature (8)..(9): 5-methyl
gtucugucc

SEQ ID NO: 5766 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(8): bicyclic nucleic acid (BNA)
  misc_feature (4)..(4): 5-methyl
  misc_feature (8)..(8): 5-methyl
gtucugtc

SEQ ID NO: 5767 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
  misc_feature (5)..(5): 5-methyl
  misc_feature (9)..(10): 5-methyl
  misc_feature (14)..(16): 5-methyl
aguucuguccaagcccggtt

SEQ ID NO: 5768 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
  misc_feature (5)..(5): 5-methyl
  misc_feature (9)..(10): 5-methyl
  misc_feature (14)..(16): 5-methyl
aguucuguccaagcccggt

SEQ ID NO: 5769 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (5)..(5): 5-methyl
  misc_feature (9)..(10): 5-methyl
  misc_feature (14)..(16): 5-methyl
aguucuguccaagcccgg

SEQ ID NO: 5770 - RNA, 17 nt, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (5)..(5): 5-methyl
  misc_feature (9)..(10): 5-methyl
  misc_feature (14)..(16): 5-methyl
aguucuguccaagcccg

SEQ ID NO: 5771 - RNA, 16 nt, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (5)..(5): 5-methyl
  misc_feature (9)..(10): 5-methyl
  misc_feature (14)..(16): 5-methyl
aguucuguccaagccc

SEQ ID NO: 5772 - RNA, 15 nt, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (5)..(5): 5-methyl
  misc_feature (9)..(10): 5-methyl
  misc_feature (14)..(15): 5-methyl
aguucuguccaagcc

SEQ ID NO: 5773 - RNA, 14 nt, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (5)..(5): 5-methyl
  misc_feature (9)..(10): 5-methyl
  misc_feature (14)..(14): 5-methyl
aguucuguccaagc

SEQ ID NO: 5774 - RNA, 13 nt, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (5)..(5): 5-methyl
  misc_feature (9)..(10): 5-methyl
aguucuguccaag

SEQ ID NO: 5775 - RNA, 12 nt, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (5)..(5): 5-methyl
  misc_feature (9)..(10): 5-methyl
aguucuguccaa

SEQ ID NO: 5776 - RNA, 11 nt, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (5)..(5): 5-methyl
  misc_feature (9)..(10): 5-methyl
aguucugucca

SEQ ID NO: 5777 - RNA, 10 nt, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (5)..(5): 5-methyl
  misc_feature (9)..(10): 5-methyl
aguucugucc

SEQ ID NO: 5778 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
  misc_feature (5)..(5): 5-methyl
  misc_feature (9)..(9): 5-methyl
aguucugtc

SEQ ID NO: 5779 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(8): bicyclic nucleic acid (BNA)
  misc_feature (5)..(5): 5-methyl
aguucugt

SEQ ID NO: 5780 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
  misc_feature (6)..(6): 5-methyl
  misc_feature (10)..(11): 5-methyl
  misc_feature (15)..(17): 5-methyl
aaguucuguccaagcccggt

SEQ ID NO: 5781 - RNA, 19 nt, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (6)..(6): 5-methyl
  misc_feature (10)..(11): 5-methyl
  misc_feature (15)..(17): 5-methyl
aaguucuguccaagcccgg

SEQ ID NO: 5782 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (6)..(6): 5-methyl
  misc_feature (10)..(11): 5-methyl
  misc_feature (15)..(17): 5-methyl
aaguucuguccaagcccg

SEQ ID NO: 5783 - RNA, 17 nt, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (6)..(6): 5-methyl
  misc_feature (10)..(11): 5-methyl
  misc_feature (15)..(17): 5-methyl
aaguucuguccaagccc

SEQ ID NO: 5784 - RNA, 16 nt, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (6)..(6): 5-methyl
  misc_feature (10)..(11): 5-methyl
  misc_feature (15)..(16): 5-methyl
aaguucuguccaagcc

SEQ ID NO: 5785 - RNA, 15 nt, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (6)..(6): 5-methyl
  misc_feature (10)..(11): 5-methyl
  misc_feature (15)..(15): 5-methyl
aaguucuguccaagc

SEQ ID NO: 5786 - RNA, 14 nt, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (6)..(6): 5-methyl
  misc_feature (10)..(11): 5-methyl
aaguucuguccaag

SEQ ID NO: 5787 - RNA, 13 nt, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (6)..(6): 5-methyl
  misc_feature (10)..(11): 5-methyl
aaguucuguccaa

SEQ ID NO: 5788 - RNA, 12 nt, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (6)..(6): 5-methyl
  misc_feature (10)..(11): 5-methyl
aaguucugucca

SEQ ID NO: 5789 - RNA, 11 nt, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (6)..(6): 5-methyl
  misc_feature (10)..(11): 5-methyl
aaguucugucc

SEQ ID NO: 5790 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
  misc_feature (6)..(6): 5-methyl
  misc_feature (10)..(10): 5-methyl
aaguucugtc

SEQ ID NO: 5791 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
  misc_feature (6)..(6): 5-methyl
aaguucugt

SEQ ID NO: 5792 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(8): bicyclic nucleic acid (BNA)
  misc_feature (6)..(6): 5-methyl
aaguuctg

SEQ ID NO: 5793 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
  misc_feature (7)..(7): 5-methyl
  misc_feature (11)..(12): 5-methyl
  misc_feature (16)..(18): 5-methyl
taaguucuguccaagcccgg

SEQ ID NO: 5794 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
  misc_feature (7)..(7): 5-methyl
  misc_feature (11)..(12): 5-methyl
  misc_feature (16)..(18): 5-methyl
taaguucuguccaagcccg

SEQ ID NO: 5795 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
  misc_feature (7)..(7): 5-methyl
  misc_feature (11)..(12): 5-methyl
  misc_feature (16)..(18): 5-methyl
taaguucuguccaagccc

SEQ ID NO: 5796 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
  misc_feature (7)..(7): 5-methyl
  misc_feature (11)..(12): 5-methyl
  misc_feature (16)..(17): 5-methyl
taaguucuguccaagcc

SEQ ID NO: 5797 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
  misc_feature (7)..(7): 5-methyl
  misc_feature (11)..(12): 5-methyl
  misc_feature (16)..(16): 5-methyl
taaguucuguccaagc

SEQ ID NO: 5798 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (7)..(7): 5-methyl
  misc_feature (11)..(12): 5-methyl
taaguucuguccaa

SEQ ID NO: 5799 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (7)..(7): 5-methyl
  misc_feature (11)..(12): 5-methyl
taaguucugucca

SEQ ID NO: 5800 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
  misc_feature (7)..(7): 5-methyl
  misc_feature (11)..(12): 5-methyl
taaguucugucc

SEQ ID NO: 5801 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
  misc_feature (7)..(7): 5-methyl
  misc_feature (11)..(11): 5-methyl
taaguucugtc

SEQ ID NO: 5802 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
  misc_feature (7)..(7): 5-methyl
taaguucugt

SEQ ID NO: 5803 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
  misc_feature (7)..(7): 5-methyl
taaguuctg

SEQ ID NO: 5804 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(8): bicyclic nucleic acid (BNA)
  misc_feature (7)..(7): 5-methyl
taaguuct

SEQ ID NO: 5805 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
  misc_feature (8)..(8): 5-methyl
  misc_feature (12)..(13): 5-methyl
  misc_feature (17)..(19): 5-methyl
gtaaguucuguccaagcccg

SEQ ID NO: 5806 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
  misc_feature (8)..(8): 5-methyl
  misc_feature (12)..(13): 5-methyl
  misc_feature (17)..(19): 5-methyl
gtaaguucuguccaagccc

SEQ ID NO: 5807 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
  misc_feature (8)..(8): 5-methyl
  misc_feature (12)..(13): 5-methyl
  misc_feature (17)..(17): 5-methyl
gtaaguucuguccaagc

SEQ ID NO: 5808 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
  misc_feature (8)..(8): 5-methyl
  misc_feature (12)..(13): 5-methyl
gtaaguucuguccaag

SEQ ID NO: 5809 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (8)..(8): 5-methyl
  misc_feature (12)..(13): 5-methyl
gtaaguucuguccaa

SEQ ID NO: 5810 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (8)..(8): 5-methyl
  misc_feature (12)..(13): 5-methyl
gtaaguucugucca

SEQ ID NO: 5811 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (8)..(8): 5-methyl
  misc_feature (12)..(13): 5-methyl
gtaaguucugucc

SEQ ID NO: 5812 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
  misc_feature (8)..(8): 5-methyl
  misc_feature (12)..(12): 5-methyl
gtaaguucugtc

SEQ ID NO: 5813 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
  misc_feature (8)..(8): 5-methyl
gtaaguucugt

SEQ ID NO: 5814 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
  misc_feature (8)..(8): 5-methyl
gtaaguuctg

SEQ ID NO: 5815 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
  misc_feature (8)..(8): 5-methyl
gtaaguuct

SEQ ID NO: 5816 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(8): bicyclic nucleic acid (BNA)
  misc_feature (8)..(8): 5-methyl
gtaagutc

SEQ ID NO: 5817 - RNA, 20 nt, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (9)..(9): 5-methyl
  misc_feature (13)..(14): 5-methyl
  misc_feature (18)..(20): 5-methyl
gguaaguucuguccaagccc

SEQ ID NO: 5818 - RNA, 19 nt, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (9)..(9): 5-methyl
  misc_feature (13)..(14): 5-methyl
  misc_feature (18)..(19): 5-methyl
gguaaguucuguccaagcc

SEQ ID NO: 5819 - RNA, 17 nt, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (9)..(9): 5-methyl
  misc_feature (13)..(14): 5-methyl
gguaaguucuguccaag

SEQ ID NO: 5820 - RNA, 16 nt, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (9)..(9): 5-methyl
  misc_feature (13)..(14): 5-methyl
gguaaguucuguccaa

SEQ ID NO: 5821 - RNA, 15 nt, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (9)..(9): 5-methyl
  misc_feature (13)..(14): 5-methyl
gguaaguucugucca

SEQ ID NO: 5822 - RNA, 14 nt, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (9)..(9): 5-methyl
  misc_feature (13)..(14): 5-methyl
gguaaguucugucc

SEQ ID NO: 5823 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (9)..(9): 5-methyl
  misc_feature (13)..(13): 5-methyl
gguaaguucugtc

SEQ ID NO: 5824 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
  misc_feature (9)..(9): 5-methyl
gguaaguucugt

SEQ ID NO: 5825 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
  misc_feature (9)..(9): 5-methyl
gguaaguuctg

SEQ ID NO: 5826 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
  misc_feature (9)..(9): 5-methyl
gguaaguuct

SEQ ID NO: 5827 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
  misc_feature (9)..(9): 5-methyl
gguaagutc

SEQ ID NO: 5828 - RNA, 20 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(20): 5-methyl
  misc_feature (1)..(2): bicyclic nucleic acid (BNA)
  misc_feature (19)..(20): bicyclic nucleic acid (BNA)
cgguaaguucuguccaagcc

SEQ ID NO: 5829 - RNA, 19 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(19): 5-methyl
  misc_feature (1)..(2): bicyclic nucleic acid (BNA)
  misc_feature (18)..(19): bicyclic nucleic acid (BNA)
cgguaaguucuguccaagc

SEQ ID NO: 5830 - RNA, 18 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(2): bicyclic nucleic acid (BNA)
  misc_feature (17)..(18): bicyclic nucleic acid (BNA)
cgguaaguucuguccaag

SEQ ID NO: 5831 - RNA, 17 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(2): bicyclic nucleic acid (BNA)
  misc_feature (16)..(17): bicyclic nucleic acid (BNA)
cgguaaguucuguccaa

SEQ ID NO: 5832 - RNA, 16 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(2): bicyclic nucleic acid (BNA)
  misc_feature (15)..(16): bicyclic nucleic acid (BNA)
cgguaaguucugucca

SEQ ID NO: 5833 - RNA, 15 nt, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(2): bicyclic nucleic acid (BNA)
  misc_feature (14)..(15): bicyclic nucleic acid (BNA)
cgguaaguucugucc

SEQ ID NO: 5834 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (10)..(10): 5-methyl
  misc_feature (14)..(14): 5-methyl
  misc_feature (1)..(2): bicyclic nucleic acid (BNA)
  misc_feature (13)..(14): bicyclic nucleic acid (BNA)
cgguaaguucugtc

SEQ ID NO: 5835 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (10)..(10): 5-methyl
  misc_feature (1)..(2): bicyclic nucleic acid (BNA)
  misc_feature (12)..(13): bicyclic nucleic acid (BNA)
cgguaaguucugt

SEQ ID NO: 5836 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (10)..(10): 5-methyl
  misc_feature (1)..(2): bicyclic nucleic acid (BNA)
  misc_feature (11)..(12): bicyclic nucleic acid (BNA)
cgguaaguuctg

SEQ ID NO: 5837 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (10)..(10): 5-methyl
  misc_feature (1)..(2): bicyclic nucleic acid (BNA)
  misc_feature (10)..(11): bicyclic nucleic acid (BNA)
cgguaaguuct

SEQ ID NO: 5838 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (10)..(10): 5-methyl
  misc_feature (1)..(2): bicyclic nucleic acid (BNA)
  misc_feature (9)..(10): bicyclic nucleic acid (BNA)
cgguaagutc

SEQ ID NO: 5839 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (1)..(2): bicyclic nucleic acid (BNA)
  misc_feature (8)..(9): bicyclic nucleic acid (BNA)
cgguaagtt

SEQ ID NO: 5840 - DNA, 8 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (1)..(2): bicyclic nucleic acid (BNA)
  misc_feature (7)..(8): bicyclic nucleic acid (BNA)
cgguaagt

SEQ ID NO: 5841 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
  misc_feature (2)..(2): 5-methyl
  misc_feature (11)..(11): 5-methyl
  misc_feature (15)..(16): 5-methyl
  misc_feature (20)..(20): 5-methyl
tcgguaaguucuguccaagc

SEQ ID NO: 5842 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
  misc_feature (2)..(2): 5-methyl
  misc_feature (11)..(11): 5-methyl
  misc_feature (15)..(16): 5-methyl
tcgguaaguucuguccaag

SEQ ID NO: 5843 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
  misc_feature (2)..(2): 5-methyl
  misc_feature (11)..(11): 5-methyl
  misc_feature (15)..(16): 5-methyl
tcgguaaguucuguccaa

SEQ ID NO: 5844 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
  misc_feature (2)..(2): 5-methyl
  misc_feature (11)..(11): 5-methyl
  misc_feature (15)..(16): 5-methyl
tcgguaaguucugucca

SEQ ID NO: 5845 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
  misc_feature (2)..(2): 5-methyl
  misc_feature (11)..(11): 5-methyl
  misc_feature (15)..(16): 5-methyl
tcgguaaguucugucc

SEQ ID NO: 5846 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (2)..(2): 5-methyl
  misc_feature (11)..(11): 5-methyl
  misc_feature (15)..(15): 5-methyl
tcgguaaguucugtc

SEQ ID NO: 5847 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (2)..(2): 5-methyl
  misc_feature (11)..(11): 5-methyl
tcgguaaguucugt

SEQ ID NO: 5848 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (2)..(2): 5-methyl
  misc_feature (11)..(11): 5-methyl
tcgguaaguuctg

SEQ ID NO: 5849 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
  misc_feature (2)..(2): 5-methyl
  misc_feature (11)..(11): 5-methyl
tcgguaaguuct

SEQ ID NO: 5850 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
  misc_feature (2)..(2): 5-methyl
  misc_feature (11)..(11): 5-methyl
tcgguaagutc

SEQ ID NO: 5851 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
  misc_feature (2)..(2): 5-methyl
tcgguaagtt

SEQ ID NO: 5852 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
  misc_feature (2)..(2): 5-methyl
tcgguaagt

SEQ ID NO: 5853 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
  misc_feature (3)..(3): 5-methyl
  misc_feature (12)..(12): 5-methyl
  misc_feature (16)..(17): 5-methyl
gtcgguaaguucuguccaag

SEQ ID NO: 5854 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
  misc_feature (3)..(3): 5-methyl
  misc_feature (12)..(12): 5-methyl
  misc_feature (16)..(17): 5-methyl
gtcgguaaguucuguccaa

SEQ ID NO: 5855 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
  misc_feature (3)..(3): 5-methyl
  misc_feature (12)..(12): 5-methyl
  misc_feature (16)..(17): 5-methyl
gtcgguaaguucugucca

SEQ ID NO: 5856 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
  misc_feature (3)..(3): 5-methyl
  misc_feature (12)..(12): 5-methyl
  misc_feature (16)..(17): 5-methyl
gtcgguaaguucugucc

SEQ ID NO: 5857 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
  misc_feature (3)..(3): 5-methyl
  misc_feature (12)..(12): 5-methyl
  misc_feature (16)..(16): 5-methyl
gtcgguaaguucugtc

SEQ ID NO: 5858 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (3)..(3): 5-methyl
  misc_feature (12)..(12): 5-methyl
gtcgguaaguucugt

SEQ ID NO: 5859 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (3)..(3): 5-methyl
  misc_feature (12)..(12): 5-methyl
gtcgguaaguuctg

SEQ ID NO: 5860 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (3)..(3): 5-methyl
  misc_feature (12)..(12): 5-methyl
gtcgguaaguuct

SEQ ID NO: 5861 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
  misc_feature (3)..(3): 5-methyl
  misc_feature (12)..(12): 5-methyl
gtcgguaagutc

SEQ ID NO: 5862 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
  misc_feature (3)..(3): 5-methyl
gtcgguaagtt

SEQ ID NO: 5863 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
  misc_feature (3)..(3): 5-methyl
gtcgguaagt

SEQ ID NO: 5864 - RNA, 20 nt, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (4)..(4): 5-methyl
  misc_feature (13)..(13): 5-methyl
  misc_feature (17)..(18): 5-methyl
agucgguaaguucuguccaa

SEQ ID NO: 5865 - RNA, 19 nt, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (4)..(4): 5-methyl
  misc_feature (13)..(13): 5-methyl
  misc_feature (17)..(18): 5-methyl
agucgguaaguucugucca

SEQ ID NO: 5866 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
  misc_feature (4)..(4): 5-methyl
  misc_feature (13)..(13): 5-methyl
  misc_feature (17)..(17): 5-methyl
agucgguaaguucugtc

SEQ ID NO: 5867 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
  misc_feature (4)..(4): 5-methyl
  misc_feature (13)..(13): 5-methyl
agucgguaaguucugt

SEQ ID NO: 5868 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (4)..(4): 5-methyl
  misc_feature (13)..(13): 5-methyl
agucgguaaguuctg

SEQ ID NO: 5869 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (4)..(4): 5-methyl
  misc_feature (13)..(13): 5-methyl
agucgguaaguuct

SEQ ID NO: 5870 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (4)..(4): 5-methyl
  misc_feature (13)..(13): 5-methyl
agucgguaagutc

SEQ ID NO: 5871 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
  misc_feature (4)..(4): 5-methyl
agucgguaagtt

SEQ ID NO: 5872 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
  misc_feature (4)..(4): 5-methyl
agucgguaagt

SEQ ID NO: 5873 - RNA, 20 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (1)..(2): bicyclic nucleic acid (BNA)
  misc_feature (19)..(20): bicyclic nucleic acid (BNA)
cagucgguaaguucugucca

SEQ ID NO: 5874 - RNA, 19 nt, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (1)..(2): bicyclic nucleic acid (BNA)
  misc_feature (18)..(19): bicyclic nucleic acid (BNA)
cagucgguaaguucugucc

SEQ ID NO: 5875 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (14)..(14): 5-methyl
  misc_feature (18)..(18): 5-methyl
  misc_feature (1)..(2): bicyclic nucleic acid (BNA)
  misc_feature (17)..(18): bicyclic nucleic acid (BNA)
cagucgguaaguucugtc

SEQ ID NO: 5876 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (14)..(14): 5-methyl
  misc_feature (1)..(2): bicyclic nucleic acid (BNA)
  misc_feature (16)..(17): bicyclic nucleic acid (BNA)
cagucgguaaguucugt

SEQ ID NO: 5877 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (14)..(14): 5-methyl
  misc_feature (1)..(2): bicyclic nucleic acid (BNA)
  misc_feature (15)..(16): bicyclic nucleic acid (BNA)
cagucgguaaguuctg

SEQ ID NO: 5878 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (14)..(14): 5-methyl
  misc_feature (1)..(2): bicyclic nucleic acid (BNA)
  misc_feature (14)..(15): bicyclic nucleic acid (BNA)
cagucgguaaguuct

SEQ ID NO: 5879 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (14)..(14): 5-methyl
  misc_feature (1)..(2): bicyclic nucleic acid (BNA)
  misc_feature (13)..(14): bicyclic nucleic acid (BNA)
cagucgguaagutc

SEQ ID NO: 5880 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (1)..(2): bicyclic nucleic acid (BNA)
  misc_feature (12)..(13): bicyclic nucleic acid (BNA)
cagucgguaagtt

SEQ ID NO: 5881 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(5): 5-methyl
  misc_feature (1)..(2): bicyclic nucleic acid (BNA)
  misc_feature (11)..(12): bicyclic nucleic acid (BNA)
cagucgguaagt

SEQ ID NO: 5882 - RNA, 20 nt, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(20): 5-methyl
  misc_feature (1)..(2): bicyclic nucleic acid (BNA)
  misc_feature (19)..(20): bicyclic nucleic acid (BNA)
ccagucgguaaguucugucc

SEQ ID NO: 5883 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (15)..(15): 5-methyl
  misc_feature (19)..(19): 5-methyl
  misc_feature (1)..(2): bicyclic nucleic acid (BNA)
  misc_feature (18)..(19): bicyclic nucleic acid (BNA)
ccagucgguaaguucugtc

SEQ ID NO: 5884 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (15)..(15): 5-methyl
  misc_feature (1)..(2): bicyclic nucleic acid (BNA)
  misc_feature (17)..(18): bicyclic nucleic acid (BNA)
ccagucgguaaguucugt

SEQ ID NO: 5885 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (15)..(15): 5-methyl
  misc_feature (1)..(2): bicyclic nucleic acid (BNA)
  misc_feature (16)..(17): bicyclic nucleic acid (BNA)
ccagucgguaaguuctg

SEQ ID NO: 5886 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (15)..(15): 5-methyl
  misc_feature (1)..(2): bicyclic nucleic acid (BNA)
  misc_feature (15)..(16): bicyclic nucleic acid (BNA)
ccagucgguaaguuct

SEQ ID NO: 5887 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (15)..(15): 5-methyl
  misc_feature (1)..(2): bicyclic nucleic acid (BNA)
  misc_feature (14)..(15): bicyclic nucleic acid (BNA)
ccagucgguaagutc

SEQ ID NO: 5888 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (1)..(2): bicyclic nucleic acid (BNA)
  misc_feature (13)..(14): bicyclic nucleic acid (BNA)
ccagucgguaagtt

SEQ ID NO: 5889 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (6)..(6): 5-methyl
  misc_feature (1)..(2): bicyclic nucleic acid (BNA)
  misc_feature (12)..(13): bicyclic nucleic acid (BNA)
ccagucgguaagt

SEQ ID NO: 5890 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
  misc_feature (2)..(3): 5-methyl
  misc_feature (7)..(7): 5-methyl
  misc_feature (16)..(16): 5-methyl
  misc_feature (20)..(20): 5-methyl
gccagucgguaaguucugtc

SEQ ID NO: 5891 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
  misc_feature (2)..(3): 5-methyl
  misc_feature (7)..(7): 5-methyl
  misc_feature (16)..(16): 5-methyl
gccagucgguaaguucugt

SEQ ID NO: 5892 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
  misc_feature (2)..(3): 5-methyl
  misc_feature (7)..(7): 5-methyl
  misc_feature (16)..(16): 5-methyl
gccagucgguaaguuctg

SEQ ID NO: 5893 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
  misc_feature (2)..(3): 5-methyl
  misc_feature (7)..(7): 5-methyl
  misc_feature (16)..(16): 5-methyl
gccagucgguaaguuct

SEQ ID NO: 5894 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
  misc_feature (2)..(3): 5-methyl
  misc_feature (7)..(7): 5-methyl
  misc_feature (16)..(16): 5-methyl
gccagucgguaagutc

SEQ ID NO: 5895 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (2)..(3): 5-methyl
  misc_feature (7)..(7): 5-methyl
gccagucgguaagtt

SEQ ID NO: 5896 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (2)..(3): 5-methyl
  misc_feature (7)..(7): 5-methyl
gccagucgguaagt

SEQ ID NO: 5897 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 5898 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 5899 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
  misc_feature (2)..(2): 5-methyl
  misc_feature (14)..(14): 5-methyl
tcaaggaagauggcat

SEQ ID NO: 5900 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (9)..(9): 5-methyl
  misc_feature (14)..(14): 5-methyl
gaagauggcauuuct

SEQ ID NO: 5901 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (20)..(21): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucta

SEQ ID NO: 5902 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauutc

SEQ ID NO: 5903 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
  misc_feature (2)..(2): 5-methyl
  misc_feature (14)..(14): 5-methyl
tcaaggaagauggcautt

SEQ ID NO: 5904 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
  misc_feature (2)..(2): 5-methyl
  misc_feature (14)..(14): 5-methyl
tcaaggaagauggcatt

SEQ ID NO: 5905 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (2)..(2): 5-methyl
  misc_feature (14)..(14): 5-methyl
tcaaggaagauggca

SEQ ID NO: 5906 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (2)..(2): 5-methyl
  misc_feature (14)..(14): 5-methyl
tcaaggaagauggc

SEQ ID NO: 5907 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (2)..(2): 5-methyl
tcaaggaagaugg

SEQ ID NO: 5908 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (2)..(2): 5-methyl
tcaaggaagatg

SEQ ID NO: 5909 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (2)..(2): 5-methyl
tcaaggaagat

SEQ ID NO: 5910 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (2)..(2): 5-methyl
tcaaggaaga

SEQ ID NO: 5911 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
  misc_feature (2)..(2): 5-methyl
tcaaggaag

SEQ ID NO: 5912 - RNA, 21 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(2): bicyclic nucleic acid (BNA)
  misc_feature (20)..(21): bicyclic nucleic acid (BNA)
caaggaagauggcauuucuag

SEQ ID NO: 5913 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (18)..(18): 5-methyl
  misc_feature (1)..(2): bicyclic nucleic acid (BNA)
  misc_feature (19)..(20): bicyclic nucleic acid (BNA)
caaggaagauggcauuucta

SEQ ID NO: 5914 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (18)..(18): 5-methyl
  misc_feature (1)..(2): bicyclic nucleic acid (BNA)
  misc_feature (18)..(19): bicyclic nucleic acid (BNA)
caaggaagauggcauuuct

SEQ ID NO: 5915 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (18)..(18): 5-methyl
  misc_feature (1)..(2): bicyclic nucleic acid (BNA)
  misc_feature (17)..(18): bicyclic nucleic acid (BNA)
caaggaagauggcauutc

SEQ ID NO: 5916 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (1)..(2): bicyclic nucleic acid (BNA)
  misc_feature (16)..(17): bicyclic nucleic acid (BNA)
caaggaagauggcautt

SEQ ID NO: 5917 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (1)..(2): bicyclic nucleic acid (BNA)
  misc_feature (15)..(16): bicyclic nucleic acid (BNA)
caaggaagauggcatt

SEQ ID NO: 5918 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (13)..(13): 5-methyl
  misc_feature (1)..(2): bicyclic nucleic acid (BNA)
  misc_feature (14)..(15): bicyclic nucleic acid (BNA)
caaggaagauggcat

SEQ ID NO: 5919 - RNA, 14 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(2): bicyclic nucleic acid (BNA)
  misc_feature (13)..(14): bicyclic nucleic acid (BNA)
caaggaagauggca

SEQ ID NO: 5920 - RNA, 13 nt, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(2): bicyclic nucleic acid (BNA)
  misc_feature (12)..(13): bicyclic nucleic acid (BNA)
caaggaagauggc

SEQ ID NO: 5921 - RNA, 12 nt, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
  misc_feature (11)..(12): bicyclic nucleic acid (BNA)
caaggaagaugg

SEQ ID NO: 5922 - DNA, 11 bp, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
  misc_feature (10)..(11): bicyclic nucleic acid (BNA)
caaggaagatg

SEQ ID NO: 5923 - DNA, 10 bp, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
  misc_feature (9)..(10): bicyclic nucleic acid (BNA)
caaggaagat

SEQ ID NO: 5924 - RNA, 9 nt, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
  misc_feature (8)..(9): bicyclic nucleic acid (BNA)
caaggaaga

SEQ ID NO: 5925 - RNA, 8 nt, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
  misc_feature (7)..(8): bicyclic nucleic acid (BNA)
caaggaag

SEQ ID NO: 5926 - RNA, 20 nt, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (12)..(12): 5-methyl
  misc_feature (17)..(17): 5-methyl
aaggaagauggcauuucuag

SEQ ID NO: 5927 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
  misc_feature (12)..(12): 5-methyl
  misc_feature (17)..(17): 5-methyl
aaggaagauggcauuucta

SEQ ID NO: 5928 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
  misc_feature (12)..(12): 5-methyl
  misc_feature (17)..(17): 5-methyl
aaggaagauggcauuuct

SEQ ID NO: 5929 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
  misc_feature (12)..(12): 5-methyl
  misc_feature (17)..(17): 5-methyl
aaggaagauggcauutc

SEQ ID NO: 5930 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
  misc_feature (12)..(12): 5-methyl
aaggaagauggcautt

SEQ ID NO: 5931 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (12)..(12): 5-methyl
aaggaagauggcatt

SEQ ID NO: 5932 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (12)..(12): 5-methyl
aaggaagauggcat

SEQ ID NO: 5933 - RNA, 13 nt, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (12)..(12): 5-methyl
aaggaagauggca

SEQ ID NO: 5934 - RNA, 12 nt, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (12)..(12): 5-methyl
aaggaagauggc

SEQ ID NO: 5935 - RNA, 19 nt, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (11)..(11): 5-methyl
  misc_feature (16)..(16): 5-methyl
aggaagauggcauuucuag

SEQ ID NO: 5936 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
  misc_feature (11)..(11): 5-methyl
  misc_feature (16)..(16): 5-methyl
aggaagauggcauuucta

SEQ ID NO: 5937 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
  misc_feature (11)..(11): 5-methyl
  misc_feature (16)..(16): 5-methyl
aggaagauggcauuuct

SEQ ID NO: 5938 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
  misc_feature (11)..(11): 5-methyl
  misc_feature (16)..(16): 5-methyl
aggaagauggcauutc

SEQ ID NO: 5939 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (11)..(11): 5-methyl
aggaagauggcautt

SEQ ID NO: 5940 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (11)..(11): 5-methyl
aggaagauggcatt

SEQ ID NO: 5941 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (11)..(11): 5-methyl
aggaagauggcat

SEQ ID NO: 5942 - RNA, 12 nt, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (11)..(11): 5-methyl
aggaagauggca

SEQ ID NO: 5943 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (10)..(10): 5-methyl
  misc_feature (15)..(15): 5-methyl
ggaagauggcauuucuag

SEQ ID NO: 5944 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
  misc_feature (10)..(10): 5-methyl
  misc_feature (15)..(15): 5-methyl
ggaagauggcauuucta

SEQ ID NO: 5945 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
  misc_feature (10)..(10): 5-methyl
  misc_feature (15)..(15): 5-methyl
ggaagauggcauuuct

SEQ ID NO: 5946 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (10)..(10): 5-methyl
  misc_feature (15)..(15): 5-methyl
ggaagauggcauutc

SEQ ID NO: 5947 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (10)..(10): 5-methyl
ggaagauggcautt

SEQ ID NO: 5948 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (10)..(10): 5-methyl
ggaagauggcatt

SEQ ID NO: 5949 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
  misc_feature (10)..(10): 5-methyl
ggaagauggcat

SEQ ID NO: 5950 - RNA, 11 nt, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (10)..(10): 5-methyl
ggaagauggca

SEQ ID NO: 5951 - RNA, 10 nt, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (10)..(10): 5-methyl
ggaagauggc

SEQ ID NO: 5952 - RNA, 17 nt, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (9)..(9): 5-methyl
  misc_feature (14)..(14): 5-methyl
gaagauggcauuucuag

SEQ ID NO: 5953 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
  misc_feature (9)..(9): 5-methyl
  misc_feature (14)..(14): 5-methyl
gaagauggcauuucta

SEQ ID NO: 5954 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (9)..(9): 5-methyl
  misc_feature (14)..(14): 5-methyl
gaagauggcauutc

SEQ ID NO: 5955 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (9)..(9): 5-methyl
gaagauggcautt

SEQ ID NO: 5956 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
  misc_feature (9)..(9): 5-methyl
gaagauggcatt

SEQ ID NO: 5957 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
  misc_feature (9)..(9): 5-methyl
gaagauggcat

SEQ ID NO: 5958 - RNA, 10 nt, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (9)..(9): 5-methyl
gaagauggca

SEQ ID NO: 5959 - RNA, 9 nt, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
  misc_feature (9)..(9): 5-methyl
gaagauggc

SEQ ID NO: 5960 - RNA, 16 nt, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (8)..(8): 5-methyl
  misc_feature (13)..(13): 5-methyl
aagauggcauuucuag

SEQ ID NO: 5961 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (8)..(8): 5-methyl
  misc_feature (13)..(13): 5-methyl
aagauggcauuucta

SEQ ID NO: 5962 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (8)..(8): 5-methyl
  misc_feature (13)..(13): 5-methyl
aagauggcauuuct

SEQ ID NO: 5963 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (8)..(8): 5-methyl
  misc_feature (13)..(13): 5-methyl
aagauggcauutc

SEQ ID NO: 5964 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
  misc_feature (8)..(8): 5-methyl
aagauggcautt

SEQ ID NO: 5965 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
  misc_feature (8)..(8): 5-methyl
aagauggcatt

SEQ ID NO: 5966 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
  misc_feature (8)..(8): 5-methyl
aagauggcat

SEQ ID NO: 5967 - RNA, 9 nt, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
  misc_feature (8)..(8): 5-methyl
aagauggca

SEQ ID NO: 5968 - RNA, 8 nt, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
  misc_feature (8)..(8): 5-methyl
aagauggc

SEQ ID NO: 5969 - RNA, 15 nt, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (7)..(7): 5-methyl
  misc_feature (12)..(12): 5-methyl
agauggcauuucuag

SEQ ID NO: 5970 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (7)..(7): 5-methyl
  misc_feature (12)..(12): 5-methyl
agauggcauuucta

SEQ ID NO: 5971 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (7)..(7): 5-methyl
  misc_feature (12)..(12): 5-methyl
agauggcauuuct

SEQ ID NO: 5972 - DNA, 12 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
  misc_feature (7)..(7): 5-methyl
  misc_feature (12)..(12): 5-methyl
agauggcauutc

SEQ ID NO: 5973 - DNA, 11 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
  misc_feature (7)..(7): 5-methyl
agauggcautt

SEQ ID NO: 5974 - DNA, 10 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
  misc_feature (7)..(7): 5-methyl
agauggcatt

SEQ ID NO: 5975 - DNA, 9 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(9): bicyclic nucleic acid (BNA)
  misc_feature (7)..(7): 5-methyl
agauggcat

SEQ ID NO: 5976 - RNA, 8 nt, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
  misc_feature (7)..(7): 5-methyl
agauggca

SEQ ID NO: 5977 - DNA, 30 bp, Artificial Sequence; identical to SEQ ID NO: 2957
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(2): bicyclic nucleic acid (BNA)
  misc_feature (29)..(30): bicyclic nucleic acid (BNA)

SEQ ID NO: 5978 - DNA, 29 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(2): bicyclic nucleic acid (BNA)
  misc_feature (28)..(29): bicyclic nucleic acid (BNA)
ctccaacaucaaggaagauggcauuucta

SEQ ID NO: 5979 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(2): bicyclic nucleic acid (BNA)
  misc_feature (27)..(28): bicyclic nucleic acid (BNA)
ctccaacaucaaggaagauggcauuuct

SEQ ID NO: 5980 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(2): bicyclic nucleic acid (BNA)
  misc_feature (26)..(27): bicyclic nucleic acid (BNA)
ctccaacaucaaggaagauggcauutc

SEQ ID NO: 5981 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
  misc_feature (25)..(26): bicyclic nucleic acid (BNA)
ctccaacaucaaggaagauggcautt

SEQ ID NO: 5982 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
  misc_feature (24)..(25): bicyclic nucleic acid (BNA)
ctccaacaucaaggaagauggcatt

SEQ ID NO: 5983 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
  misc_feature (23)..(24): bicyclic nucleic acid (BNA)
ctccaacaucaaggaagauggcat

SEQ ID NO: 5984 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
  misc_feature (22)..(23): bicyclic nucleic acid (BNA)
ctccaacaucaaggaagauggca

SEQ ID NO: 5985 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
  misc_feature (21)..(22): bicyclic nucleic acid (BNA)
ctccaacaucaaggaagauggc

SEQ ID NO: 5986 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
  misc_feature (20)..(21): bicyclic nucleic acid (BNA)
ctccaacaucaaggaagaugg

SEQ ID NO: 5987 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
  misc_feature (19)..(20): bicyclic nucleic acid (BNA)
ctccaacaucaaggaagatg

SEQ ID NO: 5988 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
  misc_feature (18)..(19): bicyclic nucleic acid (BNA)
ctccaacaucaaggaagat

SEQ ID NO: 5989 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
  misc_feature (17)..(18): bicyclic nucleic acid (BNA)
ctccaacaucaaggaaga

SEQ ID NO: 5990 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
  misc_feature (16)..(17): bicyclic nucleic acid (BNA)
ctccaacaucaaggaag

SEQ ID NO: 5991 - DNA, 29 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (28)..(29): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacaucaaggaagauggcauuucuag

SEQ ID NO: 5992 - DNA, 28 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (27)..(28): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacaucaaggaagauggcauuucta

SEQ ID NO: 5993 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (26)..(27): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacaucaaggaagauggcauuuct

SEQ ID NO: 5994 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (25)..(26): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacaucaaggaagauggcauutc

SEQ ID NO: 5995 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (24)..(25): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggcautt

SEQ ID NO: 5996 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (23)..(24): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggcatt

SEQ ID NO: 5997 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (22)..(23): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggcat

SEQ ID NO: 5998 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (21)..(22): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggca

SEQ ID NO: 5999 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (20)..(21): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacaucaaggaagauggc

SEQ ID NO: 6000 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
  misc_feature (2)..(3): 5-methyl
  misc_feature (6)..(6): 5-methyl
  misc_feature (9)..(9): 5-methyl
tccaacaucaaggaagaugg

SEQ ID NO: 6001 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
  misc_feature (2)..(3): 5-methyl
  misc_feature (6)..(6): 5-methyl
  misc_feature (9)..(9): 5-methyl
tccaacaucaaggaagatg

SEQ ID NO: 6002 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
  misc_feature (2)..(3): 5-methyl
  misc_feature (6)..(6): 5-methyl
  misc_feature (9)..(9): 5-methyl
tccaacaucaaggaagat

SEQ ID NO: 6003 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
  misc_feature (2)..(3): 5-methyl
  misc_feature (6)..(6): 5-methyl
  misc_feature (9)..(9): 5-methyl
tccaacaucaaggaaga

SEQ ID NO: 6004 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
  misc_feature (2)..(3): 5-methyl
  misc_feature (6)..(6): 5-methyl
  misc_feature (9)..(9): 5-methyl
tccaacaucaaggaag

SEQ ID NO: 6005 - RNA, 28 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(2): bicyclic nucleic acid (BNA)
  misc_feature (27)..(28): bicyclic nucleic acid (BNA)
ccaacaucaaggaagauggcauuucuag

SEQ ID NO: 6006 - DNA, 27 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(2): bicyclic nucleic acid (BNA)
  misc_feature (26)..(27): bicyclic nucleic acid (BNA)
ccaacaucaaggaagauggcauuucta

SEQ ID NO: 6007 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(2): bicyclic nucleic acid (BNA)
  misc_feature (25)..(26): bicyclic nucleic acid (BNA)
ccaacaucaaggaagauggcauuuct

SEQ ID NO: 6008 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(2): bicyclic nucleic acid (BNA)
  misc_feature (24)..(25): bicyclic nucleic acid (BNA)
ccaacaucaaggaagauggcauutc

SEQ ID NO: 6009 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
  misc_feature (23)..(24): bicyclic nucleic acid (BNA)
ccaacaucaaggaagauggcautt

SEQ ID NO: 6010 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
  misc_feature (22)..(23): bicyclic nucleic acid (BNA)
ccaacaucaaggaagauggcatt

SEQ ID NO: 6011 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
  misc_feature (21)..(22): bicyclic nucleic acid (BNA)
ccaacaucaaggaagauggcat

SEQ ID NO: 6012 - RNA, 21 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
  misc_feature (20)..(21): bicyclic nucleic acid (BNA)
ccaacaucaaggaagauggca

SEQ ID NO: 6013 - RNA, 20 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
  misc_feature (19)..(20): bicyclic nucleic acid (BNA)
ccaacaucaaggaagauggc

SEQ ID NO: 6014 - RNA, 19 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
  misc_feature (18)..(19): bicyclic nucleic acid (BNA)
ccaacaucaaggaagaugg

SEQ ID NO: 6015 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
  misc_feature (17)..(18): bicyclic nucleic acid (BNA)
ccaacaucaaggaagatg

SEQ ID NO: 6016 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
  misc_feature (16)..(17): bicyclic nucleic acid (BNA)
ccaacaucaaggaagat

SEQ ID NO: 6017 - RNA, 16 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
  misc_feature (15)..(16): bicyclic nucleic acid (BNA)
ccaacaucaaggaaga

SEQ ID NO: 6018 - RNA, 15 nt, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
  misc_feature (14)..(15): bicyclic nucleic acid (BNA)
ccaacaucaaggaag

SEQ ID NO: 6019 - RNA, 27 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(2): bicyclic nucleic acid (BNA)
  misc_feature (26)..(27): bicyclic nucleic acid (BNA)
caacaucaaggaagauggcauuucuag

SEQ ID NO: 6020 - DNA, 26 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(2): bicyclic nucleic acid (BNA)
  misc_feature (25)..(26): bicyclic nucleic acid (BNA)
caacaucaaggaagauggcauuucta

SEQ ID NO: 6021 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(2): bicyclic nucleic acid (BNA)
  misc_feature (24)..(25): bicyclic nucleic acid (BNA)
caacaucaaggaagauggcauuuct

SEQ ID NO: 6022 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(2): bicyclic nucleic acid (BNA)
  misc_feature (23)..(24): bicyclic nucleic acid (BNA)
caacaucaaggaagauggcauutc

SEQ ID NO: 6023 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
  misc_feature (22)..(23): bicyclic nucleic acid (BNA)
caacaucaaggaagauggcautt

SEQ ID NO: 6024 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
  misc_feature (21)..(22): bicyclic nucleic acid (BNA)
caacaucaaggaagauggcatt

SEQ ID NO: 6025 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
  misc_feature (20)..(21): bicyclic nucleic acid (BNA)
caacaucaaggaagauggcat

SEQ ID NO: 6026 - RNA, 20 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
  misc_feature (19)..(20): bicyclic nucleic acid (BNA)
caacaucaaggaagauggca

SEQ ID NO: 6027 - RNA, 19 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
  misc_feature (18)..(19): bicyclic nucleic acid (BNA)
caacaucaaggaagauggc

SEQ ID NO: 6028 - RNA, 18 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
  misc_feature (17)..(18): bicyclic nucleic acid (BNA)
caacaucaaggaagaugg

SEQ ID NO: 6029 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
  misc_feature (16)..(17): bicyclic nucleic acid (BNA)
caacaucaaggaagatg

SEQ ID NO: 6030 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
  misc_feature (15)..(16): bicyclic nucleic acid (BNA)
caacaucaaggaagat

SEQ ID NO: 6031 - RNA, 15 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
  misc_feature (14)..(15): bicyclic nucleic acid (BNA)
caacaucaaggaaga

SEQ ID NO: 6032 - RNA, 14 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
  misc_feature (13)..(14): bicyclic nucleic acid (BNA)
caacaucaaggaag

SEQ ID NO: 6033 - RNA, 26 nt, Artificial Sequence
  Description of Artificial Sequence: Synthetic Antisense oligonucleotide
  misc_feature (1)..(2): bicyclic nucleic acid (BNA)
  misc_feature (25)..(26): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuucuag

SEQ ID NO: 6034 - DNA, 25 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (24)..(25): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuucta

SEQ ID NO: 6035 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (23)..(24): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauuuct

SEQ ID NO: 6036 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (22)..(23): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacaucaaggaagauggcauutc

SEQ ID NO: 6037 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (21)..(22): bicyclic nucleic acid (BNA)
  misc_feature (3)..(3): 5-methyl
  misc_feature (6)..(6): 5-methyl
  misc_feature (18)..(18): 5-methyl
aacaucaaggaagauggcautt

SEQ ID NO: 6038 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (20)..(21): bicyclic nucleic acid (BNA)
  misc_feature (3)..(3): 5-methyl
  misc_feature (6)..(6): 5-methyl
  misc_feature (18)..(18): 5-methyl
aacaucaaggaagauggcatt

SEQ ID NO: 6039 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
  misc_feature (3)..(3): 5-methyl
  misc_feature (6)..(6): 5-methyl
  misc_feature (18)..(18): 5-methyl
aacaucaaggaagauggcat

SEQ ID NO: 6040 - RNA, 19 nt, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (3)..(3): 5-methyl
  misc_feature (6)..(6): 5-methyl
  misc_feature (18)..(18): 5-methyl
aacaucaaggaagauggca

SEQ ID NO: 6041 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (3)..(3): 5-methyl
  misc_feature (6)..(6): 5-methyl
  misc_feature (18)..(18): 5-methyl
aacaucaaggaagauggc

SEQ ID NO: 6042 - RNA, 17 nt, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (3)..(3): 5-methyl
  misc_feature (6)..(6): 5-methyl
aacaucaaggaagaugg

SEQ ID NO: 6043 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
  misc_feature (3)..(3): 5-methyl
  misc_feature (6)..(6): 5-methyl
aacaucaaggaagatg

SEQ ID NO: 6044 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (3)..(3): 5-methyl
  misc_feature (6)..(6): 5-methyl
aacaucaaggaagat

SEQ ID NO: 6045 - RNA, 14 nt, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (3)..(3): 5-methyl
  misc_feature (6)..(6): 5-methyl
aacaucaaggaaga

SEQ ID NO: 6046 - RNA, 13 nt, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (3)..(3): 5-methyl
  misc_feature (6)..(6): 5-methyl
aacaucaaggaag

SEQ ID NO: 6047 - RNA, 25 nt, Artificial Sequence
  Description of Artificial Sequence: Synthetic Antisense oligonucleotide
  misc_feature (1)..(2): bicyclic nucleic acid (BNA)
  misc_feature (24)..(25): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuucuag

SEQ ID NO: 6048 - DNA, 24 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (23)..(24): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuucta

SEQ ID NO: 6049 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (22)..(23): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauuuct

SEQ ID NO: 6050 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (21)..(22): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acaucaaggaagauggcauutc

SEQ ID NO: 6051 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (20)..(21): bicyclic nucleic acid (BNA)
  misc_feature (2)..(2): 5-methyl
  misc_feature (5)..(5): 5-methyl
  misc_feature (17)..(17): 5-methyl
acaucaaggaagauggcautt

SEQ ID NO: 6052 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
  misc_feature (2)..(2): 5-methyl
  misc_feature (5)..(5): 5-methyl
  misc_feature (17)..(17): 5-methyl
acaucaaggaagauggcatt

SEQ ID NO: 6053 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
  misc_feature (2)..(2): 5-methyl
  misc_feature (5)..(5): 5-methyl
  misc_feature (17)..(17): 5-methyl
acaucaaggaagauggcat

SEQ ID NO: 6054 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (2)..(2): 5-methyl
  misc_feature (5)..(5): 5-methyl
  misc_feature (17)..(17): 5-methyl
acaucaaggaagauggca

SEQ ID NO: 6055 - RNA, 17 nt, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (2)..(2): 5-methyl
  misc_feature (5)..(5): 5-methyl
  misc_feature (17)..(17): 5-methyl
acaucaaggaagauggc

SEQ ID NO: 6056 - RNA, 16 nt, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (2)..(2): 5-methyl
  misc_feature (5)..(5): 5-methyl
acaucaaggaagaugg

SEQ ID NO: 6057 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (2)..(2): 5-methyl
  misc_feature (5)..(5): 5-methyl
acaucaaggaagatg

SEQ ID NO: 6058 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (2)..(2): 5-methyl
  misc_feature (5)..(5): 5-methyl
acaucaaggaagat

SEQ ID NO: 6059 - RNA, 13 nt, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (2)..(2): 5-methyl
  misc_feature (5)..(5): 5-methyl
acaucaaggaaga

SEQ ID NO: 6060 - RNA, 12 nt, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (2)..(2): 5-methyl
  misc_feature (5)..(5): 5-methyl
acaucaaggaag

SEQ ID NO: 6061 - RNA, 24 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(2): bicyclic nucleic acid (BNA)
  misc_feature (23)..(24): bicyclic nucleic acid (BNA)
caucaaggaagauggcauuucuag

SEQ ID NO: 6062 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(2): bicyclic nucleic acid (BNA)
  misc_feature (22)..(23): bicyclic nucleic acid (BNA)
caucaaggaagauggcauuucta

SEQ ID NO: 6063 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(2): bicyclic nucleic acid (BNA)
  misc_feature (21)..(22): bicyclic nucleic acid (BNA)
caucaaggaagauggcauuuct

SEQ ID NO: 6064 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(2): bicyclic nucleic acid (BNA)
  misc_feature (20)..(21): bicyclic nucleic acid (BNA)
caucaaggaagauggcauutc

SEQ ID NO: 6065 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
  misc_feature (19)..(20): bicyclic nucleic acid (BNA)
caucaaggaagauggcautt

SEQ ID NO: 6066 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
  misc_feature (18)..(19): bicyclic nucleic acid (BNA)
caucaaggaagauggcatt

SEQ ID NO: 6067 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
  misc_feature (17)..(18): bicyclic nucleic acid (BNA)
caucaaggaagauggcat

SEQ ID NO: 6068 - RNA, 17 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
  misc_feature (16)..(17): bicyclic nucleic acid (BNA)
caucaaggaagauggca

SEQ ID NO: 6069 - RNA, 16 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
  misc_feature (15)..(16): bicyclic nucleic acid (BNA)
caucaaggaagauggc

SEQ ID NO: 6070 - RNA, 15 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
  misc_feature (14)..(15): bicyclic nucleic acid (BNA)
caucaaggaagaugg

SEQ ID NO: 6071 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (1)..(2): bicyclic nucleic acid (BNA)
  misc_feature (13)..(14): bicyclic nucleic acid (BNA)
caucaaggaagatg

SEQ ID NO: 6072 - DNA, 13 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (4)..(4): 5-methyl
  misc_feature (1)..(2): bicyclic nucleic acid (BNA)
  misc_feature (12)..(13): bicyclic nucleic acid (BNA)
caucaaggaagat

SEQ ID NO: 6073 - RNA, 12 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
  misc_feature (11)..(12): bicyclic nucleic acid (BNA)
caucaaggaaga

SEQ ID NO: 6074 - RNA, 11 nt, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
  misc_feature (10)..(11): bicyclic nucleic acid (BNA)
caucaaggaag

SEQ ID NO: 6075 - DNA, 23 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (22)..(23): bicyclic nucleic acid (BNA)
  misc_feature (3)..(3): 5-methyl
  misc_feature (15)..(15): 5-methyl
  misc_feature (20)..(20): 5-methyl
atcaaggaagauggcauuucuag

SEQ ID NO: 6076 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (21)..(22): bicyclic nucleic acid (BNA)
  misc_feature (3)..(3): 5-methyl
  misc_feature (15)..(15): 5-methyl
  misc_feature (20)..(20): 5-methyl
atcaaggaagauggcauuucta

SEQ ID NO: 6077 - DNA, 21 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (20)..(21): bicyclic nucleic acid (BNA)
  misc_feature (3)..(3): 5-methyl
  misc_feature (15)..(15): 5-methyl
  misc_feature (20)..(20): 5-methyl
atcaaggaagauggcauuuct

SEQ ID NO: 6078 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
  misc_feature (3)..(3): 5-methyl
  misc_feature (15)..(15): 5-methyl
  misc_feature (20)..(20): 5-methyl
atcaaggaagauggcauutc

SEQ ID NO: 6079 - DNA, 19 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (18)..(19): bicyclic nucleic acid (BNA)
  misc_feature (3)..(3): 5-methyl
  misc_feature (15)..(15): 5-methyl
atcaaggaagauggcautt

SEQ ID NO: 6080 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(18): bicyclic nucleic acid (BNA)
  misc_feature (3)..(3): 5-methyl
  misc_feature (15)..(15): 5-methyl
atcaaggaagauggcatt

SEQ ID NO: 6081 - DNA, 17 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
  misc_feature (3)..(3): 5-methyl
  misc_feature (15)..(15): 5-methyl
atcaaggaagauggcat

SEQ ID NO: 6082 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (15)..(16): bicyclic nucleic acid (BNA)
  misc_feature (3)..(3): 5-methyl
  misc_feature (15)..(15): 5-methyl
atcaaggaagauggca

SEQ ID NO: 6083 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(15): bicyclic nucleic acid (BNA)
  misc_feature (3)..(3): 5-methyl
  misc_feature (15)..(15): 5-methyl
atcaaggaagauggc

SEQ ID NO: 6084 - DNA, 14 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (3)..(3): 5-methyl
atcaaggaagaugg

SEQ ID NO: 6085 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (3)..(3): 5-methyl
atcaaggaagatg

SEQ ID NO: 6086 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (3)..(3): 5-methyl
atcaaggaagat

SEQ ID NO: 6087 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (3)..(3): 5-methyl
atcaaggaaga

SEQ ID NO: 6088 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (3)..(3): 5-methyl
atcaaggaag

SEQ ID NO: 6089 - DNA, 18 bp, Artificial Sequence
  Description of Artificial Sequence: Synthetic Antisense oligonucleotide
  misc_feature (1)..(1): bicyclic nucleic acid (BNA)
ggtaagttctgtccaagc

SEQ ID NO: 6090 - DNA, 18 bp, Artificial Sequence
  Description of Artificial Sequence: Synthetic Antisense oligonucleotide
  misc_feature (1)..(1): bicyclic nucleic acid (BNA)
gtaagttctgtccaagcc

SEQ ID NO: 6091 - DNA, 18 bp, Artificial Sequence
  Description of Artificial Sequence: Synthetic Antisense oligonucleotide
  misc_feature (1)..(1): bicyclic nucleic acid (BNA)
agtcggtaagttctgtcc

SEQ ID NO: 6092 - DNA, 18 bp, Artificial Sequence
  Description of Artificial Sequence: Synthetic Antisense oligonucleotide
  misc_feature (1)..(1): bicyclic nucleic acid (BNA)
ctgtccaagcccggttga

SEQ ID NO: 6093 - DNA, 15 bp, Artificial Sequence
  Description of Artificial Sequence: Synthetic Antisense oligonucleotide
  misc_feature (1)..(1): bicyclic nucleic acid (BNA)
taagttctgtccaag

SEQ ID NO: 6094 - DNA, 20 bp, Artificial Sequence
  Description of Artificial Sequence: Synthetic Antisense oligonucleotide
  misc_feature (1)..(1): bicyclic nucleic acid (BNA)
ttctgtccaagcccggttga

SEQ ID NO: 6095 - DNA, 19 bp, Artificial Sequence
  Description of Artificial Sequence: Synthetic Antisense oligonucleotide
  misc_feature (1)..(1): bicyclic nucleic acid (BNA)
ttctgtccaagcccggttg

SEQ ID NO: 6096 - DNA, 18 bp, Artificial Sequence
  Description of Artificial Sequence: Synthetic Antisense oligonucleotide
  misc_feature (1)..(1): bicyclic nucleic acid (BNA)
ttctgtccaagcccggtt

SEQ ID NO: 6097 - DNA, 17 bp, Artificial Sequence
  Description of Artificial Sequence: Synthetic Antisense oligonucleotide
  misc_feature (1)..(1): bicyclic nucleic acid (BNA)
ttctgtccaagcccggt

SEQ ID NO: 6098 - DNA, 16 bp, Artificial Sequence
  Description of Artificial Sequence: Synthetic Antisense oligonucleotide
  misc_feature (1)..(1): bicyclic nucleic acid (BNA)
ttctgtccaagcccgg

SEQ ID NO: 6099 - DNA, 15 bp, Artificial Sequence
  Description of Artificial Sequence: Synthetic Antisense oligonucleotide
  misc_feature (1)..(1): bicyclic nucleic acid (BNA)
ttctgtccaagcccg

SEQ ID NO: 6100 - DNA, 14 bp, Artificial Sequence
  Description of Artificial Sequence: Synthetic Antisense oligonucleotide
  misc_feature (1)..(1): bicyclic nucleic acid (BNA)
ttctgtccaagccc

SEQ ID NO: 6101 - DNA, 13 bp, Artificial Sequence
  Description of Artificial Sequence: Synthetic Antisense oligonucleotide
  misc_feature (1)..(1): bicyclic nucleic acid (BNA)
ttctgtccaagcc

SEQ ID NO: 6102 - DNA, 12 bp, Artificial Sequence
  Description of Artificial Sequence: Synthetic Antisense oligonucleotide
  misc_feature (1)..(1): bicyclic nucleic acid (BNA)
ttctgtccaagc

SEQ ID NO: 6103 - DNA, 11 bp, Artificial Sequence
  Description of Artificial Sequence: Synthetic Antisense oligonucleotide
  misc_feature (1)..(1): bicyclic nucleic acid (BNA)
ttctgtccaag

SEQ ID NO: 6104 - DNA, 10 bp, Artificial Sequence
  Description of Artificial Sequence: Synthetic Antisense oligonucleotide
  misc_feature (1)..(1): bicyclic nucleic acid (BNA)
ttctgtccaa

SEQ ID NO: 6105 - DNA, 9 bp, Artificial Sequence
  Description of Artificial Sequence: Synthetic Antisense oligonucleotide
  misc_feature (1)..(1): bicyclic nucleic acid (BNA)
ttctgtcca

SEQ ID NO: 6106 - DNA, 8 bp, Artificial Sequence
  Description of Artificial Sequence: Synthetic Antisense oligonucleotide
  misc_feature (1)..(1): bicyclic nucleic acid (BNA)
ttctgtcc

SEQ ID NO: 6107 - DNA, 19 bp, Artificial Sequence
  Description of Artificial Sequence: Synthetic Antisense oligonucleotide
  misc_feature (1)..(1): bicyclic nucleic acid (BNA)
tctgtccaagcccggttga

SEQ ID NO: 6108 - DNA, 18 bp, Artificial Sequence
  Description of Artificial Sequence: Synthetic Antisense oligonucleotide
  misc_feature (1)..(1): bicyclic nucleic acid (BNA)
tctgtccaagcccggttg

SEQ ID NO: 6109 - DNA, 17 bp, Artificial Sequence
  Description of Artificial Sequence: Synthetic Antisense oligonucleotide
  misc_feature (1)..(1): bicyclic nucleic acid (BNA)
tctgtccaagcccggtt

SEQ ID NO: 6110 - DNA, 16 bp, Artificial Sequence
  Description of Artificial Sequence: Synthetic Antisense oligonucleotide
  misc_feature (1)..(1): bicyclic nucleic acid (BNA)
tctgtccaagcccggt

SEQ ID NO: 6111 - DNA, 15 bp, Artificial Sequence
  Description of Artificial Sequence: Synthetic Antisense oligonucleotide
  misc_feature (1)..(1): bicyclic nucleic acid (BNA)
tctgtccaagcccgg

SEQ ID NO: 6112 - DNA, 14 bp, Artificial Sequence
  Description of Artificial Sequence: Synthetic Antisense oligonucleotide
  misc_feature (1)..(1): bicyclic nucleic acid (BNA)
tctgtccaagcccg

SEQ ID NO: 6113 - DNA, 13 bp, Artificial Sequence
  Description of Artificial Sequence: Synthetic Antisense oligonucleotide
  misc_feature (1)..(1): bicyclic nucleic acid (BNA)
tctgtccaagccc

SEQ ID NO: 6114 - DNA, 12 bp, Artificial Sequence
  Description of Artificial Sequence: Synthetic Antisense oligonucleotide
  misc_feature (1)..(1): bicyclic nucleic acid (BNA)
tctgtccaagcc

SEQ ID NO: 6115 - DNA, 11 bp, Artificial Sequence
  Description of Artificial Sequence: Synthetic Antisense oligonucleotide
  misc_feature (1)..(1): bicyclic nucleic acid (BNA)
tctgtccaagc

SEQ ID NO: 6116 - DNA, 10 bp, Artificial Sequence
  Description of Artificial Sequence: Synthetic Antisense oligonucleotide
  misc_feature (1)..(1): bicyclic nucleic acid (BNA)
tctgtccaag

SEQ ID NO: 6117 - DNA, 9 bp, Artificial Sequence
  Description of Artificial Sequence: Synthetic Antisense oligonucleotide
  misc_feature (1)..(1): bicyclic nucleic acid (BNA)
tctgtccaa

SEQ ID NO: 6118 - DNA, 8 bp, Artificial Sequence
  Description of Artificial Sequence: Synthetic Antisense oligonucleotide
  misc_feature (1)..(1): bicyclic nucleic acid (BNA)
tctgtcca

SEQ ID NO: 6119 - DNA, 17 bp, Artificial Sequence
  Description of Artificial Sequence: Synthetic Antisense oligonucleotide
  misc_feature (1)..(1): bicyclic nucleic acid (BNA)
ctgtccaagcccggttg

SEQ ID NO: 6120 - DNA, 16 bp, Artificial Sequence
  Description of Artificial Sequence: Synthetic Antisense oligonucleotide
  misc_feature (1)..(1): bicyclic nucleic acid (BNA)
ctgtccaagcccggtt

SEQ ID NO: 6121 - DNA, 15 bp, Artificial Sequence
  Description of Artificial Sequence: Synthetic Antisense oligonucleotide
  misc_feature (1)..(1): bicyclic nucleic acid (BNA)
ctgtccaagcccggt

SEQ ID NO: 6122 - DNA, 14 bp, Artificial Sequence
  Description of Artificial Sequence: Synthetic Antisense oligonucleotide
  misc_feature (1)..(1): bicyclic nucleic acid (BNA)
ctgtccaagcccgg

SEQ ID NO: 6123 - DNA, 13 bp, Artificial Sequence
  Description of Artificial Sequence: Synthetic Antisense oligonucleotide
  misc_feature (1)..(1): bicyclic nucleic acid (BNA)
ctgtccaagcccg

SEQ ID NO: 6124 - DNA, 12 bp, Artificial Sequence
  Description of Artificial Sequence: Synthetic Antisense oligonucleotide
  misc_feature (1)..(1): bicyclic nucleic acid (BNA)
ctgtccaagccc

SEQ ID NO: 6125 - DNA, 11 bp, Artificial Sequence
  Description of Artificial Sequence: Synthetic Antisense oligonucleotide
  misc_feature (1)..(1): bicyclic nucleic acid (BNA)
ctgtccaagcc

SEQ ID NO: 6126 - DNA, 10 bp, Artificial Sequence
  Description of Artificial Sequence: Synthetic Antisense oligonucleotide
  misc_feature (1)..(1): bicyclic nucleic acid (BNA)
ctgtccaagc

SEQ ID NO: 6127 - DNA, 9 bp, Artificial Sequence
  Description of Artificial Sequence: Synthetic Antisense oligonucleotide
  misc_feature (1)..(1): bicyclic nucleic acid (BNA)
ctgtccaag

SEQ ID NO: 6128 - DNA, 8 bp, Artificial Sequence
  Description of Artificial Sequence: Synthetic Antisense oligonucleotide
  misc_feature (1)..(1): bicyclic nucleic acid (BNA)
ctgtccaa

SEQ ID NO: 6129 - DNA, 20 bp, Artificial Sequence
  Description of Artificial Sequence: Synthetic Antisense oligonucleotide
  misc_feature (1)..(1): bicyclic nucleic acid (BNA)
gttctgtccaagcccggttg

SEQ ID NO: 6130 - DNA, 19 bp, Artificial Sequence
  Description of Artificial Sequence: Synthetic Antisense oligonucleotide
  misc_feature (1)..(1): bicyclic nucleic acid (BNA)
gttctgtccaagcccggtt

SEQ ID NO: 6131 - DNA, 18 bp, Artificial Sequence
  Description of Artificial Sequence: Synthetic Antisense oligonucleotide
  misc_feature (1)..(1): bicyclic nucleic acid (BNA)
gttctgtccaagcccggt

SEQ ID NO: 6132 - DNA, 17 bp, Artificial Sequence
  Description of Artificial Sequence: Synthetic Antisense oligonucleotide
  misc_feature (1)..(1): bicyclic nucleic acid (BNA)
gttctgtccaagcccgg

SEQ ID NO: 6133 - DNA, 16 bp, Artificial Sequence
  Description of Artificial Sequence: Synthetic Antisense oligonucleotide
  misc_feature (1)..(1): bicyclic nucleic acid (BNA)
gttctgtccaagcccg

SEQ ID NO: 6134 - DNA, 15 bp, Artificial Sequence
  Description of Artificial Sequence: Synthetic Antisense oligonucleotide
  misc_feature (1)..(1): bicyclic nucleic acid (BNA)
gttctgtccaagccc

SEQ ID NO: 6135 - DNA, 14 bp, Artificial Sequence
  Description of Artificial Sequence: Synthetic Antisense oligonucleotide
  misc_feature (1)..(1): bicyclic nucleic acid (BNA)
gttctgtccaagcc

SEQ ID NO: 6136 - DNA, 13 bp, Artificial Sequence
  Description of Artificial Sequence: Synthetic Antisense oligonucleotide
  misc_feature (1)..(1): bicyclic nucleic acid (BNA)
gttctgtccaagc

SEQ ID NO: 6137 - DNA, 12 bp, Artificial Sequence
  Description of Artificial Sequence: Synthetic Antisense oligonucleotide
  misc_feature (1)..(1): bicyclic nucleic acid (BNA)
gttctgtccaag

SEQ ID NO: 6138 - DNA, 11 bp, Artificial Sequence
  Description of Artificial Sequence: Synthetic Antisense oligonucleotide
  misc_feature (1)..(1): bicyclic nucleic acid (BNA)
gttctgtccaa

SEQ ID NO: 6139 - DNA, 10 bp, Artificial Sequence
  Description of Artificial Sequence: Synthetic Antisense oligonucleotide
  misc_feature (1)..(1): bicyclic nucleic acid (BNA)
gttctgtcca

SEQ ID NO: 6140 - DNA, 9 bp, Artificial Sequence
  Description of Artificial Sequence: Synthetic Antisense oligonucleotide
  misc_feature (1)..(1): bicyclic nucleic acid (BNA)
gttctgtcc

SEQ ID NO: 6141 - DNA, 8 bp, Artificial Sequence
  Description of Artificial Sequence: Synthetic Antisense oligonucleotide
  misc_feature (1)..(1): bicyclic nucleic acid (BNA)
gttctgtc

SEQ ID NO: 6142 - DNA, 20 bp, Artificial Sequence
  Description of Artificial Sequence: Synthetic Antisense oligonucleotide
  misc_feature (1)..(1): bicyclic nucleic acid (BNA)
agttctgtccaagcccggtt

SEQ ID NO: 6143 - DNA, 19 bp, Artificial Sequence
  Description of Artificial Sequence: Synthetic Antisense oligonucleotide
  misc_feature (1)..(1): bicyclic nucleic acid (BNA)
agttctgtccaagcccggt

SEQ ID NO: 6144 - DNA, 18 bp, Artificial Sequence
  Description of Artificial Sequence: Synthetic Antisense oligonucleotide
  misc_feature (1)..(1): bicyclic nucleic acid (BNA)
agttctgtccaagcccgg

SEQ ID NO: 6145 - DNA, 17 bp, Artificial Sequence
  Description of Artificial Sequence: Synthetic Antisense oligonucleotide
  misc_feature (1)..(1): bicyclic nucleic acid (BNA)
agttctgtccaagcccg

SEQ ID NO: 6146 - DNA, 16 bp, Artificial Sequence
  Description of Artificial Sequence: Synthetic Antisense oligonucleotide
  misc_feature (1)..(1): bicyclic nucleic acid (BNA)
agttctgtccaagccc

SEQ ID NO: 6147 - DNA, 15 bp, Artificial Sequence
  Description of Artificial Sequence: Synthetic Antisense oligonucleotide
  misc_feature (1)..(1): bicyclic nucleic acid (BNA)
agttctgtccaagcc

SEQ ID NO: 6148 - DNA, 14 bp, Artificial Sequence
  Description of Artificial Sequence: Synthetic Antisense oligonucleotide
  misc_feature (1)..(1): bicyclic nucleic acid (BNA)
agttctgtccaagc

SEQ ID NO: 6149 - DNA, 13 bp, Artificial Sequence
  Description of Artificial Sequence: Synthetic Antisense oligonucleotide
  misc_feature (1)..(1): bicyclic nucleic acid (BNA)
agttctgtccaag

SEQ ID NO: 6150 - DNA, 12 bp, Artificial Sequence
  Description of Artificial Sequence: Synthetic Antisense oligonucleotide
  misc_feature (1)..(1): bicyclic nucleic acid (BNA)
agttctgtccaa

SEQ ID NO: 6151 - DNA, 11 bp, Artificial Sequence
  Description of Artificial Sequence: Synthetic Antisense oligonucleotide
  misc_feature (1)..(1): bicyclic nucleic acid (BNA)
agttctgtcca

SEQ ID NO: 6152 - DNA, 10 bp, Artificial Sequence
  Description of Artificial Sequence: Synthetic Antisense oligonucleotide
  misc_feature (1)..(1): bicyclic nucleic acid (BNA)
agttctgtcc

SEQ ID NO: 6153 - DNA, 9 bp, Artificial Sequence
  Description of Artificial Sequence: Synthetic Antisense oligonucleotide
  misc_feature (1)..(1): bicyclic nucleic acid (BNA)
agttctgtc

SEQ ID NO: 6154 - DNA, 8 bp, Artificial Sequence
  Description of Artificial Sequence: Synthetic Antisense oligonucleotide
  misc_feature (1)..(1): bicyclic nucleic acid (BNA)
agttctgt

SEQ ID NO: 6155 - DNA, 20 bp, Artificial Sequence
  Description of Artificial Sequence: Synthetic Antisense oligonucleotide
  misc_feature (1)..(1): bicyclic nucleic acid (BNA)
aagttctgtccaagcccggt

SEQ ID NO: 6156 - DNA, 19 bp, Artificial Sequence
  Description of Artificial Sequence: Synthetic Antisense oligonucleotide
  misc_feature (1)..(1): bicyclic nucleic acid (BNA)
aagttctgtccaagcccgg

SEQ ID NO: 6157 - DNA, 18 bp, Artificial Sequence
  Description of Artificial Sequence: Synthetic Antisense oligonucleotide
  misc_feature (1)..(1): bicyclic nucleic acid (BNA)
aagttctgtccaagcccg

SEQ ID NO: 6158 - DNA, 17 bp, Artificial Sequence
  Description of Artificial Sequence: Synthetic Antisense oligonucleotide
  misc_feature (1)..(1): bicyclic nucleic acid (BNA)
aagttctgtccaagccc

SEQ ID NO: 6159 - DNA, 16 bp, Artificial Sequence
  Description of Artificial Sequence: Synthetic Antisense oligonucleotide
  misc_feature (1)..(1): bicyclic nucleic acid (BNA)
aagttctgtccaagcc

SEQ ID NO: 6160 - DNA, 15 bp, Artificial Sequence
  Description of Artificial Sequence: Synthetic Antisense oligonucleotide
  misc_feature (1)..(1): bicyclic nucleic acid (BNA)
aagttctgtccaagc

SEQ ID NO: 6161 - DNA, 14 bp, Artificial Sequence
  Description of Artificial Sequence: Synthetic Antisense oligonucleotide
  misc_feature (1)..(1): bicyclic nucleic acid (BNA)
aagttctgtccaag

SEQ ID NO: 6162 - DNA, 13 bp, Artificial Sequence
  Description of Artificial Sequence: Synthetic Antisense oligonucleotide
  misc_feature (1)..(1): bicyclic nucleic acid (BNA)
aagttctgtccaa

SEQ ID NO: 6163 - DNA, 12 bp, Artificial Sequence
  Description of Artificial Sequence: Synthetic Antisense oligonucleotide
  misc_feature (1)..(1): bicyclic nucleic acid (BNA)
aagttctgtcca

SEQ ID NO: 6164 - DNA, 11 bp, Artificial Sequence
  Description of Artificial Sequence: Synthetic Antisense oligonucleotide
  misc_feature (1)..(1): bicyclic nucleic acid (BNA)
aagttctgtcc

SEQ ID NO: 6165 - DNA, 10 bp, Artificial Sequence
  Description of Artificial Sequence: Synthetic Antisense oligonucleotide
  misc_feature (1)..(1): bicyclic nucleic acid (BNA)
aagttctgtc

SEQ ID NO: 6166 - DNA, 9 bp, Artificial Sequence
  Description of Artificial Sequence: Synthetic Antisense oligonucleotide
  misc_feature (1)..(1): bicyclic nucleic acid (BNA)
aagttctgt

SEQ ID NO: 6167 - DNA, 8 bp, Artificial Sequence
  Description of Artificial Sequence: Synthetic Antisense oligonucleotide
  misc_feature (1)..(1): bicyclic nucleic acid (BNA)
aagttctg

SEQ ID NO: 6168 - DNA, 20 bp, Artificial Sequence
  Description of Artificial Sequence: Synthetic Antisense oligonucleotide
  misc_feature (1)..(1): bicyclic nucleic acid (BNA)
taagttctgtccaagcccgg

SEQ ID NO: 6169 - DNA, 19 bp, Artificial Sequence
  Description of Artificial Sequence: Synthetic Antisense oligonucleotide
  misc_feature (1)..(1): bicyclic nucleic acid (BNA)
taagttctgtccaagcccg

SEQ ID NO: 6170 - DNA, 18 bp, Artificial Sequence
  Description of Artificial Sequence: Synthetic Antisense oligonucleotide
  misc_feature (1)..(1): bicyclic nucleic acid (BNA)
taagttctgtccaagccc

SEQ ID NO: 6171 - DNA, 17 bp, Artificial Sequence
  Description of Artificial Sequence: Synthetic Antisense oligonucleotide
  misc_feature (1)..(1): bicyclic nucleic acid (BNA)
taagttctgtccaagcc

SEQ ID NO: 6172 - DNA, 16 bp, Artificial Sequence
  Description of Artificial Sequence: Synthetic Antisense oligonucleotide
  misc_feature (1)..(1): bicyclic nucleic acid (BNA)
taagttctgtccaagc

SEQ ID NO: 6173 - DNA, 14 bp, Artificial Sequence
  Description of Artificial Sequence: Synthetic Antisense oligonucleotide
  misc_feature (1)..(1): bicyclic nucleic acid (BNA)
taagttctgtccaa

SEQ ID NO: 6174 - DNA, 13 bp, Artificial Sequence
  Description of Artificial Sequence: Synthetic Antisense oligonucleotide
  misc_feature (1)..(1): bicyclic nucleic acid (BNA)
taagttctgtcca

SEQ ID NO: 6175 - DNA, 12 bp, Artificial Sequence
  Description of Artificial Sequence: Synthetic Antisense oligonucleotide
  misc_feature (1)..(1): bicyclic nucleic acid (BNA)
taagttctgtcc

SEQ ID NO: 6176 - DNA, 11 bp, Artificial Sequence
  Description of Artificial Sequence: Synthetic Antisense oligonucleotide
  misc_feature (1)..(1): bicyclic nucleic acid (BNA)
taagttctgtc

SEQ ID NO: 6177 - DNA, 10 bp, Artificial Sequence
  Description of Artificial Sequence: Synthetic Antisense oligonucleotide
  misc_feature (1)..(1): bicyclic nucleic acid (BNA)
taagttctgt

SEQ ID NO: 6178 - DNA, 9 bp, Artificial Sequence
  Description of Artificial Sequence: Synthetic Antisense oligonucleotide
  misc_feature (1)..(1): bicyclic nucleic acid (BNA)
taagttctg

SEQ ID NO: 6179 - DNA, 8 bp, Artificial Sequence
  Description of Artificial Sequence: Synthetic Antisense oligonucleotide
  misc_feature (1)..(1): bicyclic nucleic acid (BNA)
taagttct

SEQ ID NO: 6180 - DNA, 20 bp, Artificial Sequence
  Description of Artificial Sequence: Synthetic Antisense oligonucleotide
  misc_feature (1)..(1): bicyclic nucleic acid (BNA)
gtaagttctgtccaagcccg

SEQ ID NO: 6181 - DNA, 19 bp, Artificial Sequence
  Description of Artificial Sequence: Synthetic Antisense oligonucleotide
  misc_feature (1)..(1): bicyclic nucleic acid (BNA)
gtaagttctgtccaagccc

SEQ ID NO: 6182 - DNA, 17 bp, Artificial Sequence
  Description of Artificial Sequence: Synthetic Antisense oligonucleotide
  misc_feature (1)..(1): bicyclic nucleic acid (BNA)
gtaagttctgtccaagc

SEQ ID NO: 6183 - DNA, 16 bp, Artificial Sequence
  Description of Artificial Sequence: Synthetic Antisense oligonucleotide
  misc_feature (1)..(1): bicyclic nucleic acid (BNA)
gtaagttctgtccaag

SEQ ID NO: 6184 - DNA, 15 bp, Artificial Sequence
  Description of Artificial Sequence: Synthetic Antisense oligonucleotide
  misc_feature (1)..(1): bicyclic nucleic acid (BNA)
gtaagttctgtccaa

SEQ ID NO: 6185 - DNA, 14 bp, Artificial Sequence
  Description of Artificial Sequence: Synthetic Antisense oligonucleotide
  misc_feature (1)..(1): bicyclic nucleic acid (BNA)
gtaagttctgtcca

SEQ ID NO: 6186 - DNA, 13 bp, Artificial Sequence
  Description of Artificial Sequence: Synthetic Antisense oligonucleotide
  misc_feature (1)..(1): bicyclic nucleic acid (BNA)
gtaagttctgtcc

SEQ ID NO: 6187 - DNA, 12 bp, Artificial Sequence
  Description of Artificial Sequence: Synthetic Antisense oligonucleotide
  misc_feature (1)..(1): bicyclic nucleic acid (BNA)
gtaagttctgtc

SEQ ID NO: 6188 - DNA, 11 bp, Artificial Sequence
  Description of Artificial Sequence: Synthetic Antisense oligonucleotide
  misc_feature (1)..(1): bicyclic nucleic acid (BNA)
gtaagttctgt

SEQ ID NO: 6189 - DNA, 10 bp, Artificial Sequence
  Description of Artificial Sequence: Synthetic Antisense oligonucleotide
  misc_feature (1)..(1): bicyclic nucleic acid (BNA)
gtaagttctg

SEQ ID NO: 6190 - DNA, 9 bp, Artificial Sequence
  Description of Artificial Sequence: Synthetic Antisense oligonucleotide
  misc_feature (1)..(1): bicyclic nucleic acid (BNA)
gtaagttct

SEQ ID NO: 6191 - DNA, 8 bp, Artificial Sequence
  Description of Artificial Sequence: Synthetic Antisense oligonucleotide
  misc_feature (1)..(1): bicyclic nucleic acid (BNA)
gtaagttc

SEQ ID NO: 6192 - DNA, 20 bp, Artificial Sequence
  Description of Artificial Sequence: Synthetic Antisense oligonucleotide
  misc_feature (1)..(1): bicyclic nucleic acid (BNA)
ggtaagttctgtccaagccc

SEQ ID NO: 6193 - DNA, 19 bp, Artificial Sequence
  Description of Artificial Sequence: Synthetic Antisense oligonucleotide
  misc_feature (1)..(1): bicyclic nucleic acid (BNA)
ggtaagttctgtccaagcc

SEQ ID NO: 6194 - DNA, 17 bp, Artificial Sequence
  Description of Artificial Sequence: Synthetic Antisense oligonucleotide
  misc_feature (1)..(1): bicyclic nucleic acid (BNA)
ggtaagttctgtccaag

SEQ ID NO: 6195 - DNA, 16 bp, Artificial Sequence
  Description of Artificial Sequence: Synthetic Antisense oligonucleotide
  misc_feature (1)..(1): bicyclic nucleic acid (BNA)
ggtaagttctgtccaa

SEQ ID NO: 6196 - DNA, 15 bp, Artificial Sequence
  Description of Artificial Sequence: Synthetic Antisense oligonucleotide
  misc_feature (1)..(1): bicyclic nucleic acid (BNA)
ggtaagttctgtcca

SEQ ID NO: 6197 - DNA, 14 bp, Artificial Sequence
  Description of Artificial Sequence: Synthetic Antisense oligonucleotide
  misc_feature (1)..(1): bicyclic nucleic acid (BNA)
ggtaagttctgtcc

SEQ ID NO: 6198 - DNA, 13 bp, Artificial Sequence
  Description of Artificial Sequence: Synthetic Antisense oligonucleotide
  misc_feature (1)..(1): bicyclic nucleic acid (BNA)
ggtaagttctgtc

SEQ ID NO: 6199 - DNA, 12 bp, Artificial Sequence
  Description of Artificial Sequence: Synthetic Antisense oligonucleotide
  misc_feature (1)..(1): bicyclic nucleic acid (BNA)
ggtaagttctgt

SEQ ID NO: 6200 - DNA, 11 bp, Artificial Sequence
  Description of Artificial Sequence: Synthetic Antisense oligonucleotide
  misc_feature (1)..(1): bicyclic nucleic acid (BNA)
ggtaagttctg

SEQ ID NO: 6201 - DNA, 10 bp, Artificial Sequence
  Description of Artificial Sequence: Synthetic Antisense oligonucleotide
  misc_feature (1)..(1): bicyclic nucleic acid (BNA)
ggtaagttct

SEQ ID NO: 6202 - DNA, 9 bp, Artificial Sequence
  Description of Artificial Sequence: Synthetic Antisense oligonucleotide
  misc_feature (1)..(1): bicyclic nucleic acid (BNA)
ggtaagttc

SEQ ID NO: 6203 - DNA, 8 bp, Artificial Sequence
  Description of Artificial Sequence: Synthetic Antisense oligonucleotide
  misc_feature (1)..(1): bicyclic nucleic acid (BNA)
ggtaagtt

SEQ ID NO: 6204 - DNA, 20 bp, Artificial Sequence
  Description of Artificial Sequence: Synthetic Antisense oligonucleotide
  misc_feature (1)..(1): bicyclic nucleic acid (BNA)
cggtaagttctgtccaagcc

SEQ ID NO: 6205 - DNA, 19 bp, Artificial Sequence
  Description of Artificial Sequence: Synthetic Antisense oligonucleotide
  misc_feature (1)..(1): bicyclic nucleic acid (BNA)
cggtaagttctgtccaagc

SEQ ID NO: 6206 - DNA, 18 bp, Artificial Sequence
  Description of Artificial Sequence: Synthetic Antisense oligonucleotide
  misc_feature (1)..(1): bicyclic nucleic acid (BNA)
cggtaagttctgtccaag

SEQ ID NO: 6207 - DNA, 17 bp, Artificial Sequence
  Description of Artificial Sequence: Synthetic Antisense oligonucleotide
  misc_feature (1)..(1): bicyclic nucleic acid (BNA)
cggtaagttctgtccaa

SEQ ID NO: 6208 - DNA, 16 bp, Artificial Sequence
  Description of Artificial Sequence: Synthetic Antisense oligonucleotide
  misc_feature (1)..(1): bicyclic nucleic acid (BNA)
cggtaagttctgtcca

SEQ ID NO: 6209 - DNA, 15 bp, Artificial Sequence
  Description of Artificial Sequence: Synthetic Antisense oligonucleotide
  misc_feature (1)..(1): bicyclic nucleic acid (BNA)
cggtaagttctgtcc

SEQ ID NO: 6210 - DNA, 14 bp, Artificial Sequence
  Description of Artificial Sequence: Synthetic Antisense oligonucleotide
  misc_feature (1)..(1): bicyclic nucleic acid (BNA)
cggtaagttctgtc

SEQ ID NO: 6211 - DNA, 13 bp, Artificial Sequence
  Description of Artificial Sequence: Synthetic Antisense oligonucleotide
  misc_feature (1)..(1): bicyclic nucleic acid (BNA)
cggtaagttctgt

SEQ ID NO: 6212 - DNA, 12 bp, Artificial Sequence
  Description of Artificial Sequence: Synthetic Antisense oligonucleotide
  misc_feature (1)..(1): bicyclic nucleic acid (BNA)
cggtaagttctg

SEQ ID NO: 6213 - DNA, 11 bp, Artificial Sequence
  Description of Artificial Sequence: Synthetic Antisense oligonucleotide
  misc_feature (1)..(1): bicyclic nucleic acid (BNA)
cggtaagttct

SEQ ID NO: 6214 - DNA, 10 bp, Artificial Sequence
  Description of Artificial Sequence: Synthetic Antisense oligonucleotide
  misc_feature (1)..(1): bicyclic nucleic acid (BNA)
cggtaagttc

SEQ ID NO: 6215 - DNA, 9 bp, Artificial Sequence
  Description of Artificial Sequence: Synthetic Antisense oligonucleotide
  misc_feature (1)..(1): bicyclic nucleic acid (BNA)
cggtaagtt

SEQ ID NO: 6216 - DNA, 8 bp, Artificial Sequence
  Description of Artificial Sequence: Synthetic Antisense oligonucleotide
  misc_feature (1)..(1): bicyclic nucleic acid (BNA)
cggtaagt

SEQ ID NO: 6217 - DNA, 20 bp, Artificial Sequence
  Description of Artificial Sequence: Synthetic Antisense oligonucleotide
  misc_feature (1)..(1): bicyclic nucleic acid (BNA)
tcggtaagttctgtccaagc

SEQ ID NO: 6218 - DNA, 19 bp, Artificial Sequence
  Description of Artificial Sequence: Synthetic Antisense oligonucleotide
  misc_feature (1)..(1): bicyclic nucleic acid (BNA)
tcggtaagttctgtccaag

SEQ ID NO: 6219 - DNA, 18 bp, Artificial Sequence
  Description of Artificial Sequence: Synthetic Antisense oligonucleotide
  misc_feature (1)..(1): bicyclic nucleic acid (BNA)
tcggtaagttctgtccaa

SEQ ID NO: 6220 - DNA, 17 bp, Artificial Sequence
  Description of Artificial Sequence: Synthetic Antisense oligonucleotide
  misc_feature (1)..(1): bicyclic nucleic acid (BNA)
tcggtaagttctgtcca

SEQ ID NO: 6221 - DNA, 16 bp, Artificial Sequence
  Description of Artificial Sequence: Synthetic Antisense oligonucleotide
  misc_feature (1)..(1): bicyclic nucleic acid (BNA)
tcggtaagttctgtcc

SEQ ID NO: 6222 - DNA, 15 bp, Artificial Sequence
  Description of Artificial Sequence: Synthetic Antisense oligonucleotide
  misc_feature (1)..(1): bicyclic nucleic acid (BNA)
tcggtaagttctgtc

SEQ ID NO: 6223 - DNA, 14 bp, Artificial Sequence
  Description of Artificial Sequence: Synthetic Antisense oligonucleotide
  misc_feature (1)..(1): bicyclic nucleic acid (BNA)
tcggtaagttctgt

SEQ ID NO: 6224 - DNA, 13 bp, Artificial Sequence
  Description of Artificial Sequence: Synthetic Antisense oligonucleotide
  misc_feature (1)..(1): bicyclic nucleic acid (BNA)
tcggtaagttctg

SEQ ID NO: 6225 - DNA, 12 bp, Artificial Sequence
  Description of Artificial Sequence: Synthetic Antisense oligonucleotide
  misc_feature (1)..(1): bicyclic nucleic acid (BNA)
tcggtaagttct

SEQ ID NO: 6226 - DNA, 11 bp, Artificial Sequence
  Description of Artificial Sequence: Synthetic Antisense oligonucleotide
  misc_feature (1)..(1): bicyclic nucleic acid (BNA)
tcggtaagttc

SEQ ID NO: 6227 - DNA, 10 bp, Artificial Sequence
  Description of Artificial Sequence: Synthetic Antisense oligonucleotide
  misc_feature (1)..(1): bicyclic nucleic acid (BNA)
tcggtaagtt

SEQ ID NO: 6228 - DNA, 9 bp, Artificial Sequence
  Description of Artificial Sequence: Synthetic Antisense oligonucleotide
  misc_feature (1)..(1): bicyclic nucleic acid (BNA)
tcggtaagt

SEQ ID NO: 6229 - DNA, 20 bp, Artificial Sequence
  Description of Artificial Sequence: Synthetic Antisense oligonucleotide
  misc_feature (1)..(1): bicyclic nucleic acid (BNA)
gtcggtaagttctgtccaag

SEQ ID NO: 6230 - DNA, 19 bp, Artificial Sequence
  Description of Artificial Sequence: Synthetic Antisense oligonucleotide
  misc_feature (1)..(1): bicyclic nucleic acid (BNA)
gtcggtaagttctgtccaa

SEQ ID NO: 6231 - DNA, 18 bp, Artificial Sequence
  Description of Artificial Sequence: Synthetic Antisense oligonucleotide
  misc_feature (1)..(1): bicyclic nucleic acid (BNA)
gtcggtaagttctgtcca

SEQ ID NO: 6232 - DNA, 17 bp, Artificial Sequence
  Description of Artificial Sequence: Synthetic Antisense oligonucleotide
  misc_feature (1)..(1): bicyclic nucleic acid (BNA)
gtcggtaagttctgtcc

SEQ ID NO: 6233 - DNA, 16 bp, Artificial Sequence
  Description of Artificial Sequence: Synthetic Antisense oligonucleotide
  misc_feature (1)..(1): bicyclic nucleic acid (BNA)
gtcggtaagttctgtc

SEQ ID NO: 6234 - DNA, 15 bp, Artificial Sequence
  Description of Artificial Sequence: Synthetic Antisense oligonucleotide
  misc_feature (1)..(1): bicyclic nucleic acid (BNA)
gtcggtaagttctgt

SEQ ID NO: 6235 - DNA, 14 bp, Artificial Sequence
  Description of Artificial Sequence: Synthetic Antisense oligonucleotide
  misc_feature (1)..(1): bicyclic nucleic acid (BNA)
gtcggtaagttctg

SEQ ID NO: 6236 - DNA, 13 bp, Artificial Sequence
  Description of Artificial Sequence: Synthetic Antisense oligonucleotide
  misc_feature (1)..(1): bicyclic nucleic acid (BNA)
gtcggtaagttct

SEQ ID NO: 6237 - DNA, 12 bp, Artificial Sequence
  Description of Artificial Sequence: Synthetic Antisense oligonucleotide
  misc_feature (1)..(1): bicyclic nucleic acid (BNA)
gtcggtaagttc

SEQ ID NO: 6238 - DNA, 11 bp, Artificial Sequence
  Description of Artificial Sequence: Synthetic Antisense oligonucleotide
  misc_feature (1)..(1): bicyclic nucleic acid (BNA)
gtcggtaagtt

SEQ ID NO: 6239 - DNA, 10 bp, Artificial Sequence
  Description of Artificial Sequence: Synthetic Antisense oligonucleotide
  misc_feature (1)..(1): bicyclic nucleic acid (BNA)
gtcggtaagt

SEQ ID NO: 6240 - DNA, 20 bp, Artificial Sequence
  Description of Artificial Sequence: Synthetic Antisense oligonucleotide
  misc_feature (1)..(1): bicyclic nucleic acid (BNA)
agtcggtaagttctgtccaa

SEQ ID NO: 6241 - DNA, 19 bp, Artificial Sequence
  Description of Artificial Sequence: Synthetic Antisense oligonucleotide
  misc_feature (1)..(1): bicyclic nucleic acid (BNA)
agtcggtaagttctgtcca

SEQ ID NO: 6242 - DNA, 17 bp, Artificial Sequence
  Description of Artificial Sequence: Synthetic Antisense oligonucleotide
  misc_feature (1)..(1): bicyclic nucleic acid (BNA)
agtcggtaagttctgtc

SEQ ID NO: 6243 - DNA, 16 bp, Artificial Sequence
  Description of Artificial Sequence: Synthetic Antisense oligonucleotide
  misc_feature (1)..(1): bicyclic nucleic acid (BNA)
agtcggtaagttctgt

SEQ ID NO: 6244 - DNA, 15 bp, Artificial Sequence
  Description of Artificial Sequence: Synthetic Antisense oligonucleotide
  misc_feature (1)..(1): bicyclic nucleic acid (BNA)
agtcggtaagttctg

SEQ ID NO: 6245 - DNA, 14 bp, Artificial Sequence
  Description of Artificial Sequence: Synthetic Antisense oligonucleotide
  misc_feature (1)..(1): bicyclic nucleic acid (BNA)
agtcggtaagttct

SEQ ID NO: 6246 - DNA, 13 bp, Artificial Sequence
  Description of Artificial Sequence: Synthetic Antisense oligonucleotide
  misc_feature (1)..(1): bicyclic nucleic acid (BNA)
agtcggtaagttc

SEQ ID NO: 6247 - DNA, 12 bp, Artificial Sequence
  Description of Artificial Sequence: Synthetic Antisense oligonucleotide
  misc_feature (1)..(1): bicyclic nucleic acid (BNA)
agtcggtaagtt

SEQ ID NO: 6248 - DNA, 11 bp, Artificial Sequence
  Description of Artificial Sequence: Synthetic Antisense oligonucleotide
  misc_feature (1)..(1): bicyclic nucleic acid (BNA)
agtcggtaagt

SEQ ID NO: 6249 - DNA, 20 bp, Artificial Sequence
  Description of Artificial Sequence: Synthetic Antisense oligonucleotide
  misc_feature (1)..(1): bicyclic nucleic acid (BNA)
cagtcggtaagttctgtcca

SEQ ID NO: 6250 - DNA, 19 bp, Artificial Sequence
  Description of Artificial Sequence: Synthetic Antisense oligonucleotide
  misc_feature (1)..(1): bicyclic nucleic acid (BNA)
cagtcggtaagttctgtcc

SEQ ID NO: 6251 - DNA, 18 bp, Artificial Sequence
  Description of Artificial Sequence: Synthetic Antisense oligonucleotide
  misc_feature (1)..(1): bicyclic nucleic acid (BNA)
cagtcggtaagttctgtc

SEQ ID NO: 6252 - DNA, 17 bp, Artificial Sequence
  Description of Artificial Sequence: Synthetic Antisense oligonucleotide
  misc_feature (1)..(1): bicyclic nucleic acid (BNA)
cagtcggtaagttctgt

SEQ ID NO: 6253 - DNA, 16 bp, Artificial Sequence
  Description of Artificial Sequence: Synthetic Antisense oligonucleotide
  misc_feature (1)..(1): bicyclic nucleic acid (BNA)
cagtcggtaagttctg

SEQ ID NO: 6254 - DNA, 15 bp, Artificial Sequence
  Description of Artificial Sequence: Synthetic Antisense oligonucleotide
  misc_feature (1)..(1): bicyclic nucleic acid (BNA)
cagtcggtaagttct

SEQ ID NO: 6255 - DNA, 14 bp, Artificial Sequence
  Description of Artificial Sequence: Synthetic Antisense oligonucleotide
  misc_feature (1)..(1): bicyclic nucleic acid (BNA)
cagtcggtaagttc

SEQ ID NO: 6256 - DNA, 13 bp, Artificial Sequence
  Description of Artificial Sequence: Synthetic Antisense oligonucleotide
  misc_feature (1)..(1): bicyclic nucleic acid (BNA)
cagtcggtaagtt

SEQ ID NO: 6257 - DNA, 12 bp, Artificial Sequence
  Description of Artificial Sequence: Synthetic Antisense oligonucleotide
  misc_feature (1)..(1): bicyclic nucleic acid (BNA)
cagtcggtaagt

SEQ ID NO: 6258 - DNA, 20 bp, Artificial Sequence
  Description of Artificial Sequence: Synthetic Antisense oligonucleotide
  misc_feature (1)..(1): bicyclic nucleic acid (BNA)
ccagtcggtaagttctgtcc

SEQ ID NO: 6259 - DNA, 19 bp, Artificial Sequence
  Description of Artificial Sequence: Synthetic Antisense oligonucleotide
  misc_feature (1)..(1): bicyclic nucleic acid (BNA)
ccagtcggtaagttctgtc

SEQ ID NO: 6260 - DNA, 18 bp, Artificial Sequence
  Description of Artificial Sequence: Synthetic Antisense oligonucleotide
  misc_feature (1)..(1): bicyclic nucleic acid (BNA)
ccagtcggtaagttctgt

SEQ ID NO: 6261 - DNA, 17 bp, Artificial Sequence
  Description of Artificial Sequence: Synthetic Antisense oligonucleotide
  misc_feature (1)..(1): bicyclic nucleic acid (BNA)
ccagtcggtaagttctg

SEQ ID NO: 6262 - DNA, 16 bp, Artificial Sequence
  Description of Artificial Sequence: Synthetic Antisense oligonucleotide
  misc_feature (1)..(1): bicyclic nucleic acid (BNA)
ccagtcggtaagttct

SEQ ID NO: 6263 - DNA, 15 bp, Artificial Sequence
  Description of Artificial Sequence: Synthetic Antisense oligonucleotide
  misc_feature (1)..(1): bicyclic nucleic acid (BNA)
ccagtcggtaagttc

SEQ ID NO: 6264 - DNA, 14 bp, Artificial Sequence
  Description of Artificial Sequence: Synthetic Antisense oligonucleotide
  misc_feature (1)..(1): bicyclic nucleic acid (BNA)
ccagtcggtaagtt

SEQ ID NO: 6265 - DNA, 13 bp, Artificial Sequence
  Description of Artificial Sequence: Synthetic Antisense oligonucleotide
  misc_feature (1)..(1): bicyclic nucleic acid (BNA)
ccagtcggtaagt

SEQ ID NO: 6266 - DNA, 20 bp, Artificial Sequence
  Description of Artificial Sequence: Synthetic Antisense oligonucleotide
  misc_feature (1)..(1): bicyclic nucleic acid (BNA)
gccagtcggtaagttctgtc

SEQ ID NO: 6267 - DNA, 19 bp, Artificial Sequence
  Description of Artificial Sequence: Synthetic Antisense oligonucleotide
  misc_feature (1)..(1): bicyclic nucleic acid (BNA)
gccagtcggtaagttctgt

SEQ ID NO: 6268 - DNA, 18 bp, Artificial Sequence
  Description of Artificial Sequence: Synthetic Antisense oligonucleotide
  misc_feature (1)..(1): bicyclic nucleic acid (BNA)
gccagtcggtaagttctg

SEQ ID NO: 6269 - DNA, 17 bp, Artificial Sequence
  Description of Artificial Sequence: Synthetic Antisense oligonucleotide
  misc_feature (1)..(1): bicyclic nucleic acid (BNA)
gccagtcggtaagttct

SEQ ID NO: 6270 - DNA, 16 bp, Artificial Sequence
  Description of Artificial Sequence: Synthetic Antisense oligonucleotide
  misc_feature (1)..(1): bicyclic nucleic acid (BNA)
gccagtcggtaagttc

SEQ ID NO: 6271 - DNA, 15 bp, Artificial Sequence
  Description of Artificial Sequence: Synthetic Antisense oligonucleotide
  misc_feature (1)..(1): bicyclic nucleic acid (BNA)
gccagtcggtaagtt

SEQ ID NO: 6272 - DNA, 14 bp, Artificial Sequence
  Description of Artificial Sequence: Synthetic Antisense oligonucleotide
  misc_feature (1)..(1): bicyclic nucleic acid (BNA)
gccagtcggtaagt

SEQ ID NO: 6273 - DNA, 20 bp, Artificial Sequence
  Description of Artificial Sequence: Synthetic Antisense oligonucleotide
  misc_feature (1)..(1): bicyclic nucleic acid (BNA)
tcaaggaagatggcatttct

SEQ ID NO: 6274 - DNA, 22 bp, Artificial Sequence
  Description of Artificial Sequence: Synthetic Antisense oligonucleotide
  misc_feature (1)..(1): bicyclic nucleic acid (BNA)
tcaaggaagatggcatttctag

SEQ ID NO: 6275 - DNA, 16 bp, Artificial Sequence
  Description of Artificial Sequence: Synthetic Antisense oligonucleotide
  misc_feature (1)..(1): bicyclic nucleic acid (BNA)
tcaaggaagatggcat

SEQ ID NO: 6276 - DNA, 15 bp, Artificial Sequence
  Description of Artificial Sequence: Synthetic Antisense oligonucleotide
  misc_feature (1)..(1): bicyclic nucleic acid (BNA)
gaagatggcatttct

SEQ ID NO: 6277 - DNA, 21 bp, Artificial Sequence
  Description of Artificial Sequence: Synthetic Antisense oligonucleotide
  misc_feature (1)..(1): bicyclic nucleic acid (BNA)
tcaaggaagatggcatttcta

SEQ ID NO: 6278 - DNA, 19 bp, Artificial Sequence
  Description of Artificial Sequence: Synthetic Antisense oligonucleotide
  misc_feature (1)..(1): bicyclic nucleic acid (BNA)
tcaaggaagatggcatttc

SEQ ID NO: 6279 - DNA, 18 bp, Artificial Sequence
  Description of Artificial Sequence: Synthetic Antisense oligonucleotide
  misc_feature (1)..(1): bicyclic nucleic acid (BNA)
tcaaggaagatggcattt

SEQ ID NO: 6280 - DNA, 17 bp, Artificial Sequence
  Description of Artificial Sequence: Synthetic Antisense oligonucleotide
  misc_feature (1)..(1): bicyclic nucleic acid (BNA)
tcaaggaagatggcatt

SEQ ID NO: 6281 - DNA, 15 bp, Artificial Sequence
  Description of Artificial Sequence: Synthetic Antisense oligonucleotide
  misc_feature (1)..(1): bicyclic nucleic acid (BNA)
tcaaggaagatggca

SEQ ID NO: 6282 - DNA, 14 bp, Artificial Sequence
  Description of Artificial Sequence: Synthetic Antisense oligonucleotide
  misc_feature (1)..(1): bicyclic nucleic acid (BNA)
tcaaggaagatggc

SEQ ID NO: 6283 - DNA, 13 bp, Artificial Sequence
  Description of Artificial Sequence: Synthetic Antisense oligonucleotide
  misc_feature (1)..(1): bicyclic nucleic acid (BNA)
tcaaggaagatgg

SEQ ID NO: 6284 - DNA, 12 bp, Artificial Sequence
  Description of Artificial Sequence: Synthetic Antisense oligonucleotide
  misc_feature (1)..(1): bicyclic nucleic acid (BNA)
tcaaggaagatg

SEQ ID NO: 6285 - DNA, 11 bp, Artificial Sequence
  Description of Artificial Sequence: Synthetic Antisense oligonucleotide
  misc_feature (1)..(1): bicyclic nucleic acid (BNA)
tcaaggaagat

SEQ ID NO: 6286 - DNA, 10 bp, Artificial Sequence
  Description of Artificial Sequence: Synthetic Antisense oligonucleotide
  misc_feature (1)..(1): bicyclic nucleic acid (BNA)
tcaaggaaga

SEQ ID NO: 6287 - DNA, 9 bp, Artificial Sequence
  Description of Artificial Sequence: Synthetic Antisense oligonucleotide
  misc_feature (1)..(1): bicyclic nucleic acid (BNA)
tcaaggaag

SEQ ID NO: 6288 - DNA, 21 bp, Artificial Sequence
  Description of Artificial Sequence: Synthetic Antisense oligonucleotide
  misc_feature (1)..(1): bicyclic nucleic acid (BNA)
caaggaagatggcatttctag

SEQ ID NO: 6289 - DNA, 20 bp, Artificial Sequence
  Description of Artificial Sequence: Synthetic Antisense oligonucleotide
  misc_feature (1)..(1): bicyclic nucleic acid (BNA)
caaggaagatggcatttcta

SEQ ID NO: 6290 - DNA, 19 bp, Artificial Sequence
  Description of Artificial Sequence: Synthetic Antisense oligonucleotide
  misc_feature (1)..(1): bicyclic nucleic acid (BNA)
caaggaagatggcatttct

SEQ ID NO: 6291 - DNA, 18 bp, Artificial Sequence
  Description of Artificial Sequence: Synthetic Antisense oligonucleotide
  misc_feature (1)..(1): bicyclic nucleic acid (BNA)
caaggaagatggcatttc

SEQ ID NO: 6292 - DNA, 17 bp, Artificial Sequence
  Description of Artificial Sequence: Synthetic Antisense oligonucleotide
  misc_feature (1)..(1): bicyclic nucleic acid (BNA)
caaggaagatggcattt

SEQ ID NO: 6293 - DNA, 16 bp, Artificial Sequence
  Description of Artificial Sequence: Synthetic Antisense oligonucleotide
  misc_feature (1)..(1): bicyclic nucleic acid (BNA)
caaggaagatggcatt

SEQ ID NO: 6294 - DNA, 15 bp, Artificial Sequence
  Description of Artificial Sequence: Synthetic Antisense oligonucleotide
  misc_feature (1)..(1): bicyclic nucleic acid (BNA)
caaggaagatggcat

SEQ ID NO: 6295 - DNA, 14 bp, Artificial Sequence
  Description of Artificial Sequence: Synthetic Antisense oligonucleotide
  misc_feature (1)..(1): bicyclic nucleic acid (BNA)
caaggaagatggca

SEQ ID NO: 6296 - DNA, 13 bp, Artificial Sequence
  Description of Artificial Sequence: Synthetic Antisense oligonucleotide
  misc_feature (1)..(1): bicyclic nucleic acid (BNA)
caaggaagatggc

SEQ ID NO: 6297 - DNA, 12 bp, Artificial Sequence
  Description of Artificial Sequence: Synthetic Antisense oligonucleotide
  misc_feature (1)..(1): bicyclic nucleic acid (BNA)
caaggaagatgg

SEQ ID NO: 6298 - DNA, 11 bp, Artificial Sequence
  Description of Artificial Sequence: Synthetic Antisense oligonucleotide
  misc_feature (1)..(1): bicyclic nucleic acid (BNA)
caaggaagatg

SEQ ID NO: 6299 - DNA, 10 bp, Artificial Sequence
  Description of Artificial Sequence: Synthetic Antisense oligonucleotide
  misc_feature (1)..(1): bicyclic nucleic acid (BNA)
caaggaagat

SEQ ID NO: 6300 - DNA, 20 bp, Artificial Sequence
  Description of Artificial Sequence: Synthetic Antisense oligonucleotide
  misc_feature (1)..(1): bicyclic nucleic acid (BNA)
aaggaagatggcatttctag

SEQ ID NO: 6301 - DNA, 19 bp, Artificial Sequence
  Description of Artificial Sequence: Synthetic Antisense oligonucleotide
  misc_feature (1)..(1): bicyclic nucleic acid (BNA)
aaggaagatggcatttcta

SEQ ID NO: 6302 - DNA, 18 bp, Artificial Sequence
  Description of Artificial Sequence: Synthetic Antisense oligonucleotide
  misc_feature (1)..(1): bicyclic nucleic acid (BNA)
aaggaagatggcatttct

SEQ ID NO: 6303 - DNA, 17 bp, Artificial Sequence
  Description of Artificial Sequence: Synthetic Antisense oligonucleotide
  misc_feature (1)..(1): bicyclic nucleic acid (BNA)
aaggaagatggcatttc

SEQ ID NO: 6304 - DNA, 16 bp, Artificial Sequence
  Description of Artificial Sequence: Synthetic Antisense oligonucleotide
  misc_feature (1)..(1): bicyclic nucleic acid (BNA)
aaggaagatggcattt

SEQ ID NO: 6305 - DNA, 15 bp, Artificial Sequence
  Description of Artificial Sequence: Synthetic Antisense oligonucleotide
  misc_feature (1)..(1): bicyclic nucleic acid (BNA)
aaggaagatggcatt

SEQ ID NO: 6306 - DNA, 14 bp, Artificial Sequence
  Description of Artificial Sequence: Synthetic Antisense oligonucleotide
  misc_feature (1)..(1): bicyclic nucleic acid (BNA)
aaggaagatggcat

SEQ ID NO: 6307 - DNA, 13 bp, Artificial Sequence
  Description of Artificial Sequence: Synthetic Antisense oligonucleotide
  misc_feature (1)..(1): bicyclic nucleic acid (BNA)
aaggaagatggca

SEQ ID NO: 6308 - DNA, 12 bp, Artificial Sequence
  Description of Artificial Sequence: Synthetic Antisense oligonucleotide
  misc_feature (1)..(1): bicyclic nucleic acid (BNA)
aaggaagatggc

SEQ ID NO: 6309 - DNA, 11 bp, Artificial Sequence
  Description of Artificial Sequence: Synthetic Antisense oligonucleotide
  misc_feature (1)..(1): bicyclic nucleic acid (BNA)
aaggaagatgg

SEQ ID NO: 6310 - DNA, 10 bp, Artificial Sequence
  Description of Artificial Sequence: Synthetic Antisense oligonucleotide
  misc_feature (1)..(1): bicyclic nucleic acid (BNA)
aaggaagatg

SEQ ID NO: 6311 - DNA, 9 bp, Artificial Sequence
  Description of Artificial Sequence: Synthetic Antisense oligonucleotide
  misc_feature (1)..(1): bicyclic nucleic acid (BNA)
aaggaagat

SEQ ID NO: 6312 - DNA, 19 bp, Artificial Sequence
  Description of Artificial Sequence: Synthetic Antisense oligonucleotide
  misc_feature (1)..(1): bicyclic nucleic acid (BNA)
aggaagatggcatttctag

SEQ ID NO: 6313 - DNA, 18 bp, Artificial Sequence
  Description of Artificial Sequence: Synthetic Antisense oligonucleotide
  misc_feature (1)..(1): bicyclic nucleic acid (BNA)
aggaagatggcatttcta

SEQ ID NO: 6314 - DNA, 17 bp, Artificial Sequence
  Description of Artificial Sequence: Synthetic Antisense oligonucleotide
  misc_feature (1)..(1): bicyclic nucleic acid (BNA)
aggaagatggcatttct

SEQ ID NO: 6315 - DNA, 16 bp, Artificial Sequence
  Description of Artificial Sequence: Synthetic Antisense oligonucleotide
  misc_feature (1)..(1): bicyclic nucleic acid (BNA)
aggaagatggcatttc

SEQ ID NO: 6316 - DNA, 15 bp, Artificial Sequence
  Description of Artificial Sequence: Synthetic Antisense oligonucleotide
  misc_feature (1)..(1): bicyclic nucleic acid (BNA)
aggaagatggcattt

SEQ ID NO: 6317 - DNA, 14 bp, Artificial Sequence
  Description of Artificial Sequence: Synthetic Antisense oligonucleotide
  misc_feature (1)..(1): bicyclic nucleic acid (BNA)
aggaagatggcatt

SEQ ID NO: 6318 - DNA, 13 bp, Artificial Sequence
  Description of Artificial Sequence: Synthetic Antisense oligonucleotide
  misc_feature (1)..(1): bicyclic nucleic acid (BNA)
aggaagatggcat

SEQ ID NO: 6319 - DNA, 12 bp, Artificial Sequence
  Description of Artificial Sequence: Synthetic Antisense oligonucleotide
  misc_feature (1)..(1): bicyclic nucleic acid (BNA)
aggaagatggca

SEQ ID NO: 6320 - DNA, 10 bp, Artificial Sequence
  Description of Artificial Sequence: Synthetic Antisense oligonucleotide
  misc_feature (1)..(1): bicyclic nucleic acid (BNA)
aggaagatgg

SEQ ID NO: 6321 - DNA, 9 bp, Artificial Sequence
  Description of Artificial Sequence: Synthetic Antisense oligonucleotide
  misc_feature (1)..(1): bicyclic nucleic acid (BNA)
aggaagatg

SEQ ID NO: 6322 - DNA, 8 bp, Artificial Sequence
  Description of Artificial Sequence: Synthetic Antisense oligonucleotide
  misc_feature (1)..(1): bicyclic nucleic acid (BNA)
aggaagat

SEQ ID NO: 6323 - DNA, 18 bp, Artificial Sequence
  Description of Artificial Sequence: Synthetic Antisense oligonucleotide
  misc_feature (1)..(1): bicyclic nucleic acid (BNA)
ggaagatggcatttctag

SEQ ID NO: 6324 - DNA, 17 bp, Artificial Sequence
  Description of Artificial Sequence: Synthetic Antisense oligonucleotide
  misc_feature (1)..(1): bicyclic nucleic acid (BNA)
ggaagatggcatttcta

SEQ ID NO: 6325 - DNA, 16 bp, Artificial Sequence
  Description of Artificial Sequence: Synthetic Antisense oligonucleotide
  misc_feature (1)..(1): bicyclic nucleic acid (BNA)
ggaagatggcatttct

SEQ ID NO: 6326 - DNA, 15 bp, Artificial Sequence
  Description of Artificial Sequence: Synthetic Antisense oligonucleotide
  misc_feature (1)..(1): bicyclic nucleic acid (BNA)
ggaagatggcatttc

SEQ ID NO: 6327 - DNA, 14 bp, Artificial Sequence
  Description of Artificial Sequence: Synthetic Antisense oligonucleotide
  misc_feature (1)..(1): bicyclic nucleic acid (BNA)
ggaagatggcattt

SEQ ID NO: 6328 - DNA, 13 bp, Artificial Sequence
  Description of Artificial Sequence: Synthetic Antisense oligonucleotide
  misc_feature (1)..(1): bicyclic nucleic acid (BNA)
ggaagatggcatt

SEQ ID NO: 6329 - DNA, 12 bp, Artificial Sequence
  Description of Artificial Sequence: Synthetic Antisense oligonucleotide
  misc_feature (1)..(1): bicyclic nucleic acid (BNA)
ggaagatggcat

SEQ ID NO: 6330 - DNA, 11 bp, Artificial Sequence
  Description of Artificial Sequence: Synthetic Antisense oligonucleotide
  misc_feature (1)..(1): bicyclic nucleic acid (BNA)
ggaagatggca

SEQ ID NO: 6331 - DNA, 10 bp, Artificial Sequence
  Description of Artificial Sequence: Synthetic Antisense oligonucleotide
  misc_feature (1)..(1): bicyclic nucleic acid (BNA)
ggaagatggc

SEQ ID NO: 6332 - DNA, 8 bp, Artificial Sequence
  Description of Artificial Sequence: Synthetic Antisense oligonucleotide
  misc_feature (1)..(1): bicyclic nucleic acid (BNA)
ggaagatg

SEQ ID NO: 6333 - DNA, 17 bp, Artificial Sequence
  Description of Artificial Sequence: Synthetic Antisense oligonucleotide
  misc_feature (1)..(1): bicyclic nucleic acid (BNA)
gaagatggcatttctag

SEQ ID NO: 6334 - DNA, 16 bp, Artificial Sequence
  Description of Artificial Sequence: Synthetic Antisense oligonucleotide
  misc_feature (1)..(1): bicyclic nucleic acid (BNA)
gaagatggcatttcta

SEQ ID NO: 6335 - DNA, 14 bp, Artificial Sequence
  Description of Artificial Sequence: Synthetic Antisense oligonucleotide
  misc_feature (1)..(1): bicyclic nucleic acid (BNA)
gaagatggcatttc

SEQ ID NO: 6336 - DNA, 13 bp, Artificial Sequence
  Description of Artificial Sequence: Synthetic Antisense oligonucleotide
  misc_feature (1)..(1): bicyclic nucleic acid (BNA)
gaagatggcattt

SEQ ID NO: 6337 - DNA, 12 bp, Artificial Sequence
  Description of Artificial Sequence: Synthetic Antisense oligonucleotide
  misc_feature (1)..(1): bicyclic nucleic acid (BNA)
gaagatggcatt

SEQ ID NO: 6338 - DNA, 11 bp, Artificial Sequence
  Description of Artificial Sequence: Synthetic Antisense oligonucleotide
  misc_feature (1)..(1): bicyclic nucleic acid (BNA)
gaagatggcat

SEQ ID NO: 6339 - DNA, 10 bp, Artificial Sequence
  Description of Artificial Sequence: Synthetic Antisense oligonucleotide
  misc_feature (1)..(1): bicyclic nucleic acid (BNA)
gaagatggca

SEQ ID NO: 6340 - DNA, 9 bp, Artificial Sequence
  Description of Artificial Sequence: Synthetic Antisense oligonucleotide
  misc_feature (1)..(1): bicyclic nucleic acid (BNA)
gaagatggc

SEQ ID NO: 6341 - DNA, 8 bp, Artificial Sequence
  Description of Artificial Sequence: Synthetic Antisense oligonucleotide
  misc_feature (1)..(1): bicyclic nucleic acid (BNA)
gaagatgg

SEQ ID NO: 6342 - DNA, 16 bp, Artificial Sequence
  Description of Artificial Sequence: Synthetic Antisense oligonucleotide
  misc_feature (1)..(1): bicyclic nucleic acid (BNA)
aagatggcatttctag

SEQ ID NO: 6343 - DNA, 15 bp, Artificial Sequence
  Description of Artificial Sequence: Synthetic Antisense oligonucleotide
  misc_feature (1)..(1): bicyclic nucleic acid (BNA)
aagatggcatttcta

SEQ ID NO: 6344 - DNA, 14 bp, Artificial Sequence
  Description of Artificial Sequence: Synthetic Antisense oligonucleotide
  misc_feature (1)..(1): bicyclic nucleic acid (BNA)
aagatggcatttct

SEQ ID NO: 6345 - DNA, 13 bp, Artificial Sequence
  Description of Artificial Sequence: Synthetic Antisense oligonucleotide
  misc_feature (1)..(1): bicyclic nucleic acid (BNA)
aagatggcatttc

SEQ ID NO: 6346 - DNA, 12 bp, Artificial Sequence
  Description of Artificial Sequence: Synthetic Antisense oligonucleotide
  misc_feature (1)..(1): bicyclic nucleic acid (BNA)
aagatggcattt

SEQ ID NO: 6347 - DNA, 11 bp, Artificial Sequence
  Description of Artificial Sequence: Synthetic Antisense oligonucleotide
  misc_feature (1)..(1): bicyclic nucleic acid (BNA)
aagatggcatt

SEQ ID NO: 6348 - DNA, 10 bp, Artificial Sequence
  Description of Artificial Sequence: Synthetic Antisense oligonucleotide
  misc_feature (1)..(1): bicyclic nucleic acid (BNA)
aagatggcat

SEQ ID NO: 6349 - DNA, 9 bp, Artificial Sequence
  Description of Artificial Sequence: Synthetic Antisense oligonucleotide
  misc_feature (1)..(1): bicyclic nucleic acid (BNA)
aagatggca

SEQ ID NO: 6350 - DNA, 8 bp, Artificial Sequence
  Description of Artificial Sequence: Synthetic Antisense oligonucleotide
  misc_feature (1)..(1): bicyclic nucleic acid (BNA)
aagatggc

SEQ ID NO: 6351 - DNA, 15 bp, Artificial Sequence
  Description of Artificial Sequence: Synthetic Antisense oligonucleotide
  misc_feature (1)..(1): bicyclic nucleic acid (BNA)
agatggcatttctag

SEQ ID NO: 6352 - DNA, 14 bp, Artificial Sequence
  Description of Artificial Sequence: Synthetic Antisense oligonucleotide
  misc_feature (1)..(1): bicyclic nucleic acid (BNA)
agatggcatttcta

SEQ ID NO: 6353 - DNA, 13 bp, Artificial Sequence
  Description of Artificial Sequence: Synthetic Antisense oligonucleotide
  misc_feature (1)..(1): bicyclic nucleic acid (BNA)
agatggcatttct

SEQ ID NO: 6354 - DNA, 12 bp, Artificial Sequence
  Description of Artificial Sequence: Synthetic Antisense oligonucleotide
  misc_feature (1)..(1): bicyclic nucleic acid (BNA)
agatggcatttc

SEQ ID NO: 6355 - DNA, 11 bp, Artificial Sequence
  Description of Artificial Sequence: Synthetic Antisense oligonucleotide
  misc_feature (1)..(1): bicyclic nucleic acid (BNA)
agatggcattt

SEQ ID NO: 6356 - DNA, 10 bp, Artificial Sequence
  Description of Artificial Sequence: Synthetic Antisense oligonucleotide
  misc_feature (1)..(1): bicyclic nucleic acid (BNA)
agatggcatt

SEQ ID NO: 6357 - DNA, 9 bp, Artificial Sequence
  Description of Artificial Sequence: Synthetic Antisense oligonucleotide
  misc_feature (1)..(1): bicyclic nucleic acid (BNA)
agatggcat

SEQ ID NO: 6358 - DNA, 8 bp, Artificial Sequence
  Description of Artificial Sequence: Synthetic Antisense oligonucleotide
  misc_feature (1)..(1): bicyclic nucleic acid (BNA)
agatggca

SEQ ID NO: 6359 - DNA, 30 bp, Artificial Sequence; identical to SEQ ID NO: 8
  Description of Artificial Sequence: Synthetic Antisense oligonucleotide
  misc_feature (1)..(1): bicyclic nucleic acid (BNA)

SEQ ID NO: 6360 - DNA, 29 bp, Artificial Sequence
  Description of Artificial Sequence: Synthetic Antisense oligonucleotide
  misc_feature (1)..(1): bicyclic nucleic acid (BNA)
ctccaacatcaaggaagatggcatttcta

SEQ ID NO: 6361 - DNA, 28 bp, Artificial Sequence
  Description of Artificial Sequence: Synthetic Antisense oligonucleotide
  misc_feature (1)..(1): bicyclic nucleic acid (BNA)
ctccaacatcaaggaagatggcatttct

SEQ ID NO: 6362 - DNA, 27 bp, Artificial Sequence
  Description of Artificial Sequence: Synthetic Antisense oligonucleotide
  misc_feature (1)..(1): bicyclic nucleic acid (BNA)
ctccaacatcaaggaagatggcatttc

SEQ ID NO: 6363 - DNA, 26 bp, Artificial Sequence
  Description of Artificial Sequence: Synthetic Antisense oligonucleotide
  misc_feature (1)..(1): bicyclic nucleic acid (BNA)
ctccaacatcaaggaagatggcattt

SEQ ID NO: 6364 - DNA, 25 bp, Artificial Sequence
  Description of Artificial Sequence: Synthetic Antisense oligonucleotide
  misc_feature (1)..(1): bicyclic nucleic acid (BNA)
ctccaacatcaaggaagatggcatt

SEQ ID NO: 6365 - DNA, 24 bp, Artificial Sequence
  Description of Artificial Sequence: Synthetic Antisense oligonucleotide
  misc_feature (1)..(1): bicyclic nucleic acid (BNA)
ctccaacatcaaggaagatggcat

SEQ ID NO: 6366 - DNA, 23 bp, Artificial Sequence
  Description of Artificial Sequence: Synthetic Antisense oligonucleotide
  misc_feature (1)..(1): bicyclic nucleic acid (BNA)
ctccaacatcaaggaagatggca

SEQ ID NO: 6367 - DNA, 22 bp, Artificial Sequence
  Description of Artificial Sequence: Synthetic Antisense oligonucleotide
  misc_feature (1)..(1): bicyclic nucleic acid (BNA)
ctccaacatcaaggaagatggc

SEQ ID NO: 6368 - DNA, 21 bp, Artificial Sequence
  Description of Artificial Sequence: Synthetic Antisense oligonucleotide
  misc_feature (1)..(1): bicyclic nucleic acid (BNA)
ctccaacatcaaggaagatgg

SEQ ID NO: 6369 - DNA, 20 bp, Artificial Sequence
  Description of Artificial Sequence: Synthetic Antisense oligonucleotide
  misc_feature (1)..(1): bicyclic nucleic acid (BNA)
ctccaacatcaaggaagatg

SEQ ID NO: 6370 - DNA, 19 bp, Artificial Sequence
  Description of Artificial Sequence: Synthetic Antisense oligonucleotide
  misc_feature (1)..(1): bicyclic nucleic acid (BNA)
ctccaacatcaaggaagat

SEQ ID NO: 6371 - DNA, 18 bp, Artificial Sequence
  Description of Artificial Sequence: Synthetic Antisense oligonucleotide
  misc_feature (1)..(1): bicyclic nucleic acid (BNA)
ctccaacatcaaggaaga

SEQ ID NO: 6372 - DNA, 17 bp, Artificial Sequence
  Description of Artificial Sequence: Synthetic Antisense oligonucleotide
  misc_feature (1)..(1): bicyclic nucleic acid (BNA)
ctccaacatcaaggaag

SEQ ID NO: 6373 - DNA, 29 bp, Artificial Sequence
  Description of Artificial Sequence: Synthetic Antisense oligonucleotide
  misc_feature (1)..(1): bicyclic nucleic acid (BNA)
tccaacatcaaggaagatggcatttctag

SEQ ID NO: 6374 - DNA, 28 bp, Artificial Sequence
  Description of Artificial Sequence: Synthetic Antisense oligonucleotide
  misc_feature (1)..(1): bicyclic nucleic acid (BNA)
tccaacatcaaggaagatggcatttcta

SEQ ID NO: 6375 - DNA, 27 bp, Artificial Sequence
  Description of Artificial Sequence: Synthetic Antisense oligonucleotide
  misc_feature (1)..(1): bicyclic nucleic acid (BNA)
tccaacatcaaggaagatggcatttct

SEQ ID NO: 6376 - DNA, 26 bp, Artificial Sequence
  Description of Artificial Sequence: Synthetic Antisense oligonucleotide
  misc_feature (1)..(1): bicyclic nucleic acid (BNA)
tccaacatcaaggaagatggcatttc

SEQ ID NO: 6377 - DNA, 25 bp, Artificial Sequence
  Description of Artificial Sequence: Synthetic Antisense oligonucleotide
  misc_feature (1)..(1): bicyclic nucleic acid (BNA)
tccaacatcaaggaagatggcattt

SEQ ID NO: 6378 - DNA, 24 bp, Artificial Sequence
  Description of Artificial Sequence: Synthetic Antisense oligonucleotide
  misc_feature (1)..(1): bicyclic nucleic acid (BNA)
tccaacatcaaggaagatggcatt

SEQ ID NO: 6379 - DNA, 23 bp, Artificial Sequence
  Description of Artificial Sequence: Synthetic Antisense oligonucleotide
  misc_feature (1)..(1): bicyclic nucleic acid (BNA)
tccaacatcaaggaagatggcat

SEQ ID NO: 6380 - DNA, 22 bp, Artificial Sequence
  Description of Artificial Sequence: Synthetic Antisense oligonucleotide
  misc_feature (1)..(1): bicyclic nucleic acid (BNA)
tccaacatcaaggaagatggca

SEQ ID NO: 6381 - DNA, 21 bp, Artificial Sequence
  Description of Artificial Sequence: Synthetic Antisense oligonucleotide
  misc_feature (1)..(1): bicyclic nucleic acid (BNA)
tccaacatcaaggaagatggc

SEQ ID NO: 6382 - DNA, 20 bp, Artificial Sequence
  Description of Artificial Sequence: Synthetic Antisense oligonucleotide
  misc_feature (1)..(1): bicyclic nucleic acid (BNA)
tccaacatcaaggaagatgg

SEQ ID NO: 6383 - DNA, 19 bp, Artificial Sequence
  Description of Artificial Sequence: Synthetic Antisense oligonucleotide
  misc_feature (1)..(1): bicyclic nucleic acid (BNA)
tccaacatcaaggaagatg

SEQ ID NO: 6384 - DNA, 18 bp, Artificial Sequence
  Description of Artificial Sequence: Synthetic Antisense oligonucleotide
  misc_feature (1)..(1): bicyclic nucleic acid (BNA)
tccaacatcaaggaagat

SEQ ID NO: 6385 - DNA, 17 bp, Artificial Sequence
  Description of Artificial Sequence: Synthetic Antisense oligonucleotide
  misc_feature (1)..(1): bicyclic nucleic acid (BNA)
tccaacatcaaggaaga

SEQ ID NO: 6386 - DNA, 16 bp, Artificial Sequence
  Description of Artificial Sequence: Synthetic Antisense oligonucleotide
  misc_feature (1)..(1): bicyclic nucleic acid (BNA)
tccaacatcaaggaag

SEQ ID NO: 6387 - DNA, 28 bp, Artificial Sequence
  Description of Artificial Sequence: Synthetic Antisense oligonucleotide
  misc_feature (1)..(1): bicyclic nucleic acid (BNA)
ccaacatcaaggaagatggcatttctag

SEQ ID NO: 6388 - DNA, 27 bp, Artificial Sequence
  Description of Artificial Sequence: Synthetic Antisense oligonucleotide
  misc_feature (1)..(1): bicyclic nucleic acid (BNA)
ccaacatcaaggaagatggcatttcta

SEQ ID NO: 6389 - DNA, 26 bp, Artificial Sequence
  Description of Artificial Sequence: Synthetic Antisense oligonucleotide
  misc_feature (1)..(1): bicyclic nucleic acid (BNA)
ccaacatcaaggaagatggcatttct

SEQ ID NO: 6390 - DNA, 25 bp, Artificial Sequence
  Description of Artificial Sequence: Synthetic Antisense oligonucleotide
  misc_feature (1)..(1): bicyclic nucleic acid (BNA)
ccaacatcaaggaagatggcatttc

SEQ ID NO: 6391 - DNA, 24 bp, Artificial Sequence
  Description of Artificial Sequence: Synthetic Antisense oligonucleotide
  misc_feature (1)..(1): bicyclic nucleic acid (BNA)
ccaacatcaaggaagatggcattt

SEQ ID NO: 6392 - DNA, 23 bp, Artificial Sequence
  Description of Artificial Sequence: Synthetic Antisense oligonucleotide
  misc_feature (1)..(1): bicyclic nucleic acid (BNA)
ccaacatcaaggaagatggcatt

SEQ ID NO: 6393 - DNA, 22 bp, Artificial Sequence
  Description of Artificial Sequence: Synthetic Antisense oligonucleotide
  misc_feature (1)..(1): bicyclic nucleic acid (BNA)
ccaacatcaaggaagatggcat

SEQ ID NO: 6394 - DNA, 21 bp, Artificial Sequence
  Description of Artificial Sequence: Synthetic Antisense oligonucleotide
  misc_feature (1)..(1): bicyclic nucleic acid (BNA)
ccaacatcaaggaagatggca

SEQ ID NO: 6395 - DNA, 20 bp, Artificial Sequence
  Description of Artificial Sequence: Synthetic Antisense oligonucleotide
  misc_feature (1)..(1): bicyclic nucleic acid (BNA)
ccaacatcaaggaagatggc

SEQ ID NO: 6396 - DNA, 19 bp, Artificial Sequence
  Description of Artificial Sequence: Synthetic Antisense oligonucleotide
  misc_feature (1)..(1): bicyclic nucleic acid (BNA)
ccaacatcaaggaagatgg

SEQ ID NO: 6397 - DNA, 18 bp, Artificial Sequence
  Description of Artificial Sequence: Synthetic Antisense oligonucleotide
  misc_feature (1)..(1): bicyclic nucleic acid (BNA)
ccaacatcaaggaagatg

SEQ ID NO: 6398 - DNA, 17 bp, Artificial Sequence
  Description of Artificial Sequence: Synthetic Antisense oligonucleotide
  misc_feature (1)..(1): bicyclic nucleic acid (BNA)
ccaacatcaaggaagat

SEQ ID NO: 6399 - DNA, 16 bp, Artificial Sequence
  Description of Artificial Sequence: Synthetic Antisense oligonucleotide
  misc_feature (1)..(1): bicyclic nucleic acid (BNA)
ccaacatcaaggaaga

SEQ ID NO: 6400 - DNA, 15 bp, Artificial Sequence
  Description of Artificial Sequence: Synthetic Antisense oligonucleotide
  misc_feature (1)..(1): bicyclic nucleic acid (BNA)
ccaacatcaaggaag

SEQ ID NO: 6401 - DNA, 27 bp, Artificial Sequence
  Description of Artificial Sequence: Synthetic Antisense oligonucleotide
  misc_feature (1)..(1): bicyclic nucleic acid (BNA)
caacatcaaggaagatggcatttctag

SEQ ID NO: 6402 - DNA, 26 bp, Artificial Sequence
  Description of Artificial Sequence: Synthetic Antisense oligonucleotide
  misc_feature (1)..(1): bicyclic nucleic acid (BNA)
caacatcaaggaagatggcatttcta

SEQ ID NO: 6403 - DNA, 25 bp, Artificial Sequence
  Description of Artificial Sequence: Synthetic Antisense oligonucleotide
  misc_feature (1)..(1): bicyclic nucleic acid (BNA)
caacatcaaggaagatggcatttct

SEQ ID NO: 6404 - DNA, 24 bp, Artificial Sequence
  Description of Artificial Sequence: Synthetic Antisense oligonucleotide
  misc_feature (1)..(1): bicyclic nucleic acid (BNA)
caacatcaaggaagatggcatttc

SEQ ID NO: 6405 - DNA, 23 bp, Artificial Sequence
  Description of Artificial Sequence: Synthetic Antisense oligonucleotide
  misc_feature (1)..(1): bicyclic nucleic acid (BNA)
caacatcaaggaagatggcattt

SEQ ID NO: 6406 - DNA, 22 bp, Artificial Sequence
  Description of Artificial Sequence: Synthetic Antisense oligonucleotide
  misc_feature (1)..(1): bicyclic nucleic acid (BNA)
caacatcaaggaagatggcatt

SEQ ID NO: 6407 - DNA, 21 bp, Artificial Sequence
  Description of Artificial Sequence: Synthetic Antisense oligonucleotide
  misc_feature (1)..(1): bicyclic nucleic acid (BNA)
caacatcaaggaagatggcat

SEQ ID NO: 6408 - DNA, 20 bp, Artificial Sequence
  Description of Artificial Sequence: Synthetic Antisense oligonucleotide
  misc_feature (1)..(1): bicyclic nucleic acid (BNA)
caacatcaaggaagatggca

SEQ ID NO: 6409 - DNA, 19 bp, Artificial Sequence
  Description of Artificial Sequence: Synthetic Antisense oligonucleotide
  misc_feature (1)..(1): bicyclic nucleic acid (BNA)
caacatcaaggaagatggc

SEQ ID NO: 6410 - DNA, 18 bp, Artificial Sequence
  Description of Artificial Sequence: Synthetic Antisense oligonucleotide
  misc_feature (1)..(1): bicyclic nucleic acid (BNA)
caacatcaaggaagatgg

SEQ ID NO: 6411 - DNA, 17 bp, Artificial Sequence
  Description of Artificial Sequence: Synthetic Antisense oligonucleotide
  misc_feature (1)..(1): bicyclic nucleic acid (BNA)
caacatcaaggaagatg

SEQ ID NO: 6412 - DNA, 16 bp, Artificial Sequence
  Description of Artificial Sequence: Synthetic Antisense oligonucleotide
  misc_feature (1)..(1): bicyclic nucleic acid (BNA)
caacatcaaggaagat

SEQ ID NO: 6413 - DNA, 15 bp, Artificial Sequence
  Description of Artificial Sequence: Synthetic Antisense oligonucleotide
  misc_feature (1)..(1): bicyclic nucleic acid (BNA)
caacatcaaggaaga

SEQ ID NO: 6414 - DNA, 14 bp, Artificial Sequence
  Description of Artificial Sequence: Synthetic Antisense oligonucleotide
  misc_feature (1)..(1): bicyclic nucleic acid (BNA)
caacatcaaggaag

SEQ ID NO: 6415 - DNA, 26 bp, Artificial Sequence
  Description of Artificial Sequence: Synthetic Antisense oligonucleotide
  misc_feature (1)..(1): bicyclic nucleic acid (BNA)
aacatcaaggaagatggcatttctag

SEQ ID NO: 6416 - DNA, 25 bp, Artificial Sequence
  Description of Artificial Sequence: Synthetic Antisense oligonucleotide
  misc_feature (1)..(1): bicyclic nucleic acid (BNA)
aacatcaaggaagatggcatttcta

SEQ ID NO: 6417 - DNA, 24 bp, Artificial Sequence
  Description of Artificial Sequence: Synthetic Antisense oligonucleotide
  misc_feature (1)..(1): bicyclic nucleic acid (BNA)
aacatcaaggaagatggcatttct

SEQ ID NO: 6418 - DNA, 23 bp, Artificial Sequence
  Description of Artificial Sequence: Synthetic Antisense oligonucleotide
  misc_feature (1)..(1): bicyclic nucleic acid (BNA)
aacatcaaggaagatggcatttc

SEQ ID NO: 6419 - DNA, 22 bp, Artificial Sequence
  Description of Artificial Sequence: Synthetic Antisense oligonucleotide
  misc_feature (1)..(1): bicyclic nucleic acid (BNA)
aacatcaaggaagatggcattt

SEQ ID NO: 6420 - DNA, 21 bp, Artificial Sequence
  Description of Artificial Sequence: Synthetic Antisense oligonucleotide
  misc_feature (1)..(1): bicyclic nucleic acid (BNA)
aacatcaaggaagatggcatt

SEQ ID NO: 6421 - DNA, 20 bp, Artificial Sequence
  Description of Artificial Sequence: Synthetic Antisense oligonucleotide
  misc_feature (1)..(1): bicyclic nucleic acid (BNA)
aacatcaaggaagatggcat

SEQ ID NO: 6422 - DNA, 19 bp, Artificial Sequence
  Description of Artificial Sequence: Synthetic Antisense oligonucleotide
  misc_feature (1)..(1): bicyclic nucleic acid (BNA)
aacatcaaggaagatggca

SEQ ID NO: 6423 - DNA, 18 bp, Artificial Sequence
  Description of Artificial Sequence: Synthetic Antisense oligonucleotide
  misc_feature (1)..(1): bicyclic nucleic acid (BNA)
aacatcaaggaagatggc

SEQ ID NO: 6424 - DNA, 17 bp, Artificial Sequence
  Description of Artificial Sequence: Synthetic Antisense oligonucleotide
  misc_feature (1)..(1): bicyclic nucleic acid (BNA)
aacatcaaggaagatgg

SEQ ID NO: 6425 - DNA, 16 bp, Artificial Sequence
  Description of Artificial Sequence: Synthetic Antisense oligonucleotide
  misc_feature (1)..(1): bicyclic nucleic acid (BNA)
aacatcaaggaagatg

SEQ ID NO: 6426 - DNA, 15 bp, Artificial Sequence
  Description of Artificial Sequence: Synthetic Antisense oligonucleotide
  misc_feature (1)..(1): bicyclic nucleic acid (BNA)
aacatcaaggaagat

SEQ ID NO: 6427 - DNA, 14 bp, Artificial Sequence
  Description of Artificial Sequence: Synthetic Antisense oligonucleotide
  misc_feature (1)..(1): bicyclic nucleic acid (BNA)
aacatcaaggaaga

SEQ ID NO: 6428 - DNA, 13 bp, Artificial Sequence
  Description of Artificial Sequence: Synthetic Antisense oligonucleotide
  misc_feature (1)..(1): bicyclic nucleic acid (BNA)
aacatcaaggaag

SEQ ID NO: 6429 - DNA, 25 bp, Artificial Sequence
  Description of Artificial Sequence: Synthetic Antisense oligonucleotide
  misc_feature (1)..(1): bicyclic nucleic acid (BNA)
acatcaaggaagatggcatttctag

SEQ ID NO: 6430 - DNA, 24 bp, Artificial Sequence
  Description of Artificial Sequence: Synthetic Antisense oligonucleotide
  misc_feature (1)..(1): bicyclic nucleic acid (BNA)
acatcaaggaagatggcatttcta

SEQ ID NO: 6431 - DNA, 23 bp, Artificial Sequence
  Description of Artificial Sequence: Synthetic Antisense oligonucleotide
  misc_feature (1)..(1): bicyclic nucleic acid (BNA)
acatcaaggaagatggcatttct

SEQ ID NO: 6432 - DNA, 22 bp, Artificial Sequence
  Description of Artificial Sequence: Synthetic Antisense oligonucleotide
  misc_feature (1)..(1): bicyclic nucleic acid (BNA)
acatcaaggaagatggcatttc

SEQ ID NO: 6433 - DNA, 21 bp, Artificial Sequence
  Description of Artificial Sequence: Synthetic Antisense oligonucleotide
  misc_feature (1)..(1): bicyclic nucleic acid (BNA)
acatcaaggaagatggcattt

SEQ ID NO: 6434 - DNA, 20 bp, Artificial Sequence
  Description of Artificial Sequence: Synthetic Antisense oligonucleotide
  misc_feature (1)..(1): bicyclic nucleic acid (BNA)
acatcaaggaagatggcatt

SEQ ID NO: 6435 - DNA, 19 bp, Artificial Sequence
  Description of Artificial Sequence: Synthetic Antisense oligonucleotide
  misc_feature (1)..(1): bicyclic nucleic acid (BNA)
acatcaaggaagatggcat

SEQ ID NO: 6436 - DNA, 18 bp, Artificial Sequence
  Description of Artificial Sequence: Synthetic Antisense oligonucleotide
  misc_feature (1)..(1): bicyclic nucleic acid (BNA)
acatcaaggaagatggca

SEQ ID NO: 6437 - DNA, 17 bp, Artificial Sequence
  Description of Artificial Sequence: Synthetic Antisense oligonucleotide
  misc_feature (1)..(1): bicyclic nucleic acid (BNA)
acatcaaggaagatggc

SEQ ID NO: 6438 - DNA, 16 bp, Artificial Sequence
  Description of Artificial Sequence: Synthetic Antisense oligonucleotide
  misc_feature (1)..(1): bicyclic nucleic acid (BNA)
acatcaaggaagatgg

SEQ ID NO: 6439 - DNA, 15 bp, Artificial Sequence
  Description of Artificial Sequence: Synthetic Antisense oligonucleotide
  misc_feature (1)..(1): bicyclic nucleic acid (BNA)
acatcaaggaagatg

SEQ ID NO: 6440 - DNA, 14 bp, Artificial Sequence
  Description of Artificial Sequence: Synthetic Antisense oligonucleotide
  misc_feature (1)..(1): bicyclic nucleic acid (BNA)
acatcaaggaagat

SEQ ID NO: 6441 - DNA, 13 bp, Artificial Sequence
  Description of Artificial Sequence: Synthetic Antisense oligonucleotide
  misc_feature (1)..(1): bicyclic nucleic acid (BNA)
acatcaaggaaga

SEQ ID NO: 6442 - DNA, 12 bp, Artificial Sequence
  Description of Artificial Sequence: Synthetic Antisense oligonucleotide
  misc_feature (1)..(1): bicyclic nucleic acid (BNA)
acatcaaggaag

SEQ ID NO: 6443 - DNA, 24 bp, Artificial Sequence
  Description of Artificial Sequence: Synthetic Antisense oligonucleotide
  misc_feature (1)..(1): bicyclic nucleic acid (BNA)
catcaaggaagatggcatttctag

SEQ ID NO: 6444 - DNA, 23 bp, Artificial Sequence
  Description of Artificial Sequence: Synthetic Antisense oligonucleotide
  misc_feature (1)..(1): bicyclic nucleic acid (BNA)
catcaaggaagatggcatttcta

SEQ ID NO: 6445 - DNA, 22 bp, Artificial Sequence
  Description of Artificial Sequence: Synthetic Antisense oligonucleotide
  misc_feature (1)..(1): bicyclic nucleic acid (BNA)
catcaaggaagatggcatttct

SEQ ID NO: 6446 - DNA, 21 bp, Artificial Sequence
  Description of Artificial Sequence: Synthetic Antisense oligonucleotide
  misc_feature (1)..(1): bicyclic nucleic acid (BNA)
catcaaggaagatggcatttc

SEQ ID NO: 6447 - DNA, 20 bp, Artificial Sequence
  Description of Artificial Sequence: Synthetic Antisense oligonucleotide
  misc_feature (1)..(1): bicyclic nucleic acid (BNA)
catcaaggaagatggcattt

SEQ ID NO: 6448 - DNA, 19 bp, Artificial Sequence
  Description of Artificial Sequence: Synthetic Antisense oligonucleotide
  misc_feature (1)..(1): bicyclic nucleic acid (BNA)
catcaaggaagatggcatt

SEQ ID NO: 6449 - DNA, 18 bp, Artificial Sequence
  Description of Artificial Sequence: Synthetic Antisense oligonucleotide
  misc_feature (1)..(1): bicyclic nucleic acid (BNA)
catcaaggaagatggcat

SEQ ID NO: 6450 - DNA, 17 bp, Artificial Sequence
  Description of Artificial Sequence: Synthetic Antisense oligonucleotide
  misc_feature (1)..(1): bicyclic nucleic acid (BNA)
catcaaggaagatggca

SEQ ID NO: 6451 - DNA, 16 bp, Artificial Sequence
  Description of Artificial Sequence: Synthetic Antisense oligonucleotide
  misc_feature (1)..(1): bicyclic nucleic acid (BNA)
catcaaggaagatggc

SEQ ID NO: 6452 - DNA, 15 bp, Artificial Sequence
  Description of Artificial Sequence: Synthetic Antisense oligonucleotide
  misc_feature (1)..(1): bicyclic nucleic acid (BNA)
catcaaggaagatgg

SEQ ID NO: 6453 - DNA, 14 bp, Artificial Sequence
  Description of Artificial Sequence: Synthetic Antisense oligonucleotide
  misc_feature (1)..(1): bicyclic nucleic acid (BNA)
catcaaggaagatg

SEQ ID NO: 6454 - DNA, 13 bp, Artificial Sequence
  Description of Artificial Sequence: Synthetic Antisense oligonucleotide
  misc_feature (1)..(1): bicyclic nucleic acid (BNA)
catcaaggaagat

SEQ ID NO: 6455 - DNA, 12 bp, Artificial Sequence
  Description of Artificial Sequence: Synthetic Antisense oligonucleotide
  misc_feature (1)..(1): bicyclic nucleic acid (BNA)
catcaaggaaga

SEQ ID NO: 6456 - DNA, 11 bp, Artificial Sequence
  Description of Artificial Sequence: Synthetic Antisense oligonucleotide
  misc_feature (1)..(1): bicyclic nucleic acid (BNA)
catcaaggaag

SEQ ID NO: 6457 - DNA, 23 bp, Artificial Sequence
  Description of Artificial Sequence: Synthetic Antisense oligonucleotide
  misc_feature (1)..(1): bicyclic nucleic acid (BNA)
atcaaggaagatggcatttctag

SEQ ID NO: 6458 - DNA, 22 bp, Artificial Sequence
  Description of Artificial Sequence: Synthetic Antisense oligonucleotide
  misc_feature (1)..(1): bicyclic nucleic acid (BNA)
atcaaggaagatggcatttcta

SEQ ID NO: 6459 - DNA, 21 bp, Artificial Sequence
  Description of Artificial Sequence: Synthetic Antisense oligonucleotide
  misc_feature (1)..(1): bicyclic nucleic acid (BNA)
atcaaggaagatggcatttct

SEQ ID NO: 6460 - DNA, 20 bp, Artificial Sequence
  Description of Artificial Sequence: Synthetic Antisense oligonucleotide
  misc_feature (1)..(1): bicyclic nucleic acid (BNA)
atcaaggaagatggcatttc

SEQ ID NO: 6461 - DNA, 19 bp, Artificial Sequence
  Description of Artificial Sequence: Synthetic Antisense oligonucleotide
  misc_feature (1)..(1): bicyclic nucleic acid (BNA)
atcaaggaagatggcattt

SEQ ID NO: 6462 - DNA, 18 bp, Artificial Sequence
  Description of Artificial Sequence: Synthetic Antisense oligonucleotide
  misc_feature (1)..(1): bicyclic nucleic acid (BNA)
atcaaggaagatggcatt

SEQ ID NO: 6463 - DNA, 17 bp, Artificial Sequence
  Description of Artificial Sequence: Synthetic Antisense oligonucleotide
  misc_feature (1)..(1): bicyclic nucleic acid (BNA)
atcaaggaagatggcat

SEQ ID NO: 6464 - DNA, 16 bp, Artificial Sequence
  Description of Artificial Sequence: Synthetic Antisense oligonucleotide
  misc_feature (1)..(1): bicyclic nucleic acid (BNA)
atcaaggaagatggca

SEQ ID NO: 6465 - DNA, 15 bp, Artificial Sequence
  Description of Artificial Sequence: Synthetic Antisense oligonucleotide
  misc_feature (1)..(1): bicyclic nucleic acid (BNA)
atcaaggaagatggc

SEQ ID NO: 6466 - DNA, 14 bp, Artificial Sequence
  Description of Artificial Sequence: Synthetic Antisense oligonucleotide
  misc_feature (1)..(1): bicyclic nucleic acid (BNA)
atcaaggaagatgg

SEQ ID NO: 6467 - DNA, 13 bp, Artificial Sequence
  Description of Artificial Sequence: Synthetic Antisense oligonucleotide
  misc_feature (1)..(1): bicyclic nucleic acid (BNA)
atcaaggaagatg

SEQ ID NO: 6468 - DNA, 12 bp, Artificial Sequence
  Description of Artificial Sequence: Synthetic Antisense oligonucleotide
  misc_feature (1)..(1): bicyclic nucleic acid (BNA)
atcaaggaagat

SEQ ID NO: 6469 - DNA, 11 bp, Artificial Sequence
  Description of Artificial Sequence: Synthetic Antisense oligonucleotide
  misc_feature (1)..(1): bicyclic nucleic acid (BNA)
atcaaggaaga

SEQ ID NO: 6470 - DNA, 10 bp, Artificial Sequence
  Description of Artificial Sequence: Synthetic Antisense oligonucleotide
  misc_feature (1)..(1): bicyclic nucleic acid (BNA)
atcaaggaag

SEQ ID NO: 6471 - DNA, 18 bp, Artificial Sequence
  Description of Artificial Sequence: Synthetic Antisense oligonucleotide
  misc_feature (18)..(18): bicyclic nucleic acid (BNA)
ggtaagttctgtccaagc

SEQ ID NO: 6472 - DNA, 18 bp, Artificial Sequence
  Description of Artificial Sequence: Synthetic Antisense oligonucleotide
  misc_feature (18)..(18): bicyclic nucleic acid (BNA)
gtaagttctgtccaagcc

SEQ ID NO: 6473 - DNA, 18 bp, Artificial Sequence
  Description of Artificial Sequence: Synthetic Antisense oligonucleotide
  misc_feature (18)..(18): bicyclic nucleic acid (BNA)
agtcggtaagttctgtcc

SEQ ID NO: 6474 - DNA, 18 bp, Artificial Sequence
  Description of Artificial Sequence: Synthetic Antisense oligonucleotide
  misc_feature (18)..(18): bicyclic nucleic acid (BNA)
ctgtccaagcccggttga

SEQ ID NO: 6475 - DNA, 15 bp, Artificial Sequence
  Description of Artificial Sequence: Synthetic Antisense oligonucleotide
  misc_feature (15)..(15): bicyclic nucleic acid (BNA)
taagttctgtccaag

SEQ ID NO: 6476 - DNA, 20 bp, Artificial Sequence
  Description of Artificial Sequence: Synthetic Antisense oligonucleotide
  misc_feature (20)..(20): bicyclic nucleic acid (BNA)
ttctgtccaagcccggttga

SEQ ID NO: 6477 - DNA, 19 bp, Artificial Sequence
  Description of Artificial Sequence: Synthetic Antisense oligonucleotide
  misc_feature (19)..(19): bicyclic nucleic acid (BNA)
ttctgtccaagcccggttg

SEQ ID NO: 6478 - DNA, 18 bp, Artificial Sequence
  Description of Artificial Sequence: Synthetic Antisense oligonucleotide
  misc_feature (18)..(18): bicyclic nucleic acid (BNA)
ttctgtccaagcccggtt

SEQ ID NO: 6479 - DNA, 17 bp, Artificial Sequence
  Description of Artificial Sequence: Synthetic Antisense oligonucleotide
  misc_feature (17)..(17): bicyclic nucleic acid (BNA)
ttctgtccaagcccggt

SEQ ID NO: 6480 - DNA, 16 bp, Artificial Sequence
  Description of Artificial Sequence: Synthetic Antisense oligonucleotide
  misc_feature (16)..(16): bicyclic nucleic acid (BNA)
ttctgtccaagcccgg

SEQ ID NO: 6481 - DNA, 15 bp, Artificial Sequence
  Description of Artificial Sequence: Synthetic Antisense oligonucleotide
  misc_feature (15)..(15): bicyclic nucleic acid (BNA)
ttctgtccaagcccg

SEQ ID NO: 6482 - DNA, 14 bp, Artificial Sequence
  Description of Artificial Sequence: Synthetic Antisense oligonucleotide
  misc_feature (14)..(14): bicyclic nucleic acid (BNA)
ttctgtccaagccc

SEQ ID NO: 6483 - DNA, 13 bp, Artificial Sequence
  Description of Artificial Sequence: Synthetic Antisense oligonucleotide
  misc_feature (13)..(13): bicyclic nucleic acid (BNA)
ttctgtccaagcc

SEQ ID NO: 6484 - DNA, 12 bp, Artificial Sequence
  Description of Artificial Sequence: Synthetic Antisense oligonucleotide
  misc_feature (12)..(12): bicyclic nucleic acid (BNA)
ttctgtccaagc

SEQ ID NO: 6485 - DNA, 11 bp, Artificial Sequence
  Description of Artificial Sequence: Synthetic Antisense oligonucleotide
  misc_feature (11)..(11): bicyclic nucleic acid (BNA)
ttctgtccaag

SEQ ID NO: 6486 - DNA, 10 bp, Artificial Sequence
  Description of Artificial Sequence: Synthetic Antisense oligonucleotide
  misc_feature (10)..(10): bicyclic nucleic acid (BNA)
ttctgtccaa

SEQ ID NO: 6487 - DNA, 9 bp, Artificial Sequence
  Description of Artificial Sequence: Synthetic Antisense oligonucleotide
  misc_feature (9)..(9): bicyclic nucleic acid (BNA)
ttctgtcca

SEQ ID NO: 6488 - DNA, 8 bp, Artificial Sequence
  Description of Artificial Sequence: Synthetic Antisense oligonucleotide
  misc_feature (8)..(8): bicyclic nucleic acid (BNA)
ttctgtcc

SEQ ID NO: 6489 - DNA, 19 bp, Artificial Sequence
  Description of Artificial Sequence: Synthetic Antisense oligonucleotide
  misc_feature (19)..(19): bicyclic nucleic acid (BNA)
tctgtccaagcccggttga

SEQ ID NO: 6490 - DNA, 18 bp, Artificial Sequence
  Description of Artificial Sequence: Synthetic Antisense oligonucleotide
  misc_feature (18)..(18): bicyclic nucleic acid (BNA)
tctgtccaagcccggttg

SEQ ID NO: 6491 - DNA, 17 bp, Artificial Sequence
  Description of Artificial Sequence: Synthetic Antisense oligonucleotide
  misc_feature (17)..(17): bicyclic nucleic acid (BNA)
tctgtccaagcccggtt

SEQ ID NO: 6492 - DNA, 16 bp, Artificial Sequence
  Description of Artificial Sequence: Synthetic Antisense oligonucleotide
  misc_feature (16)..(16): bicyclic nucleic acid (BNA)
tctgtccaagcccggt

SEQ ID NO: 6493 - DNA, 15 bp, Artificial Sequence
  Description of Artificial Sequence: Synthetic Antisense oligonucleotide
  misc_feature (15)..(15): bicyclic nucleic acid (BNA)
tctgtccaagcccgg

SEQ ID NO: 6494 - DNA, 14 bp, Artificial Sequence
  Description of Artificial Sequence: Synthetic Antisense oligonucleotide
  misc_feature (14)..(14): bicyclic nucleic acid (BNA)
tctgtccaagcccg

SEQ ID NO: 6495 - DNA, 13 bp, Artificial Sequence
  Description of Artificial Sequence: Synthetic Antisense oligonucleotide
  misc_feature (13)..(13): bicyclic nucleic acid (BNA)
tctgtccaagccc

SEQ ID NO: 6496 - DNA, 12 bp, Artificial Sequence
  Description of Artificial Sequence: Synthetic Antisense oligonucleotide
  misc_feature (12)..(12): bicyclic nucleic acid (BNA)
tctgtccaagcc

SEQ ID NO: 6497 - DNA, 11 bp, Artificial Sequence
  Description of Artificial Sequence: Synthetic Antisense oligonucleotide
  misc_feature (11)..(11): bicyclic nucleic acid (BNA)
tctgtccaagc

SEQ ID NO: 6498 - DNA, 10 bp, Artificial Sequence
  Description of Artificial Sequence: Synthetic Antisense oligonucleotide
  misc_feature (10)..(10): bicyclic nucleic acid (BNA)
tctgtccaag

SEQ ID NO: 6499 - DNA, 9 bp, Artificial Sequence
  Description of Artificial Sequence: Synthetic Antisense oligonucleotide
  misc_feature (9)..(9): bicyclic nucleic acid (BNA)
tctgtccaa

SEQ ID NO: 6500 - DNA, 8 bp, Artificial Sequence
  Description of Artificial Sequence: Synthetic Antisense oligonucleotide
  misc_feature (8)..(8): bicyclic nucleic acid (BNA)
tctgtcca

SEQ ID NO: 6501 - DNA, 17 bp, Artificial Sequence
  Description of Artificial Sequence: Synthetic Antisense oligonucleotide
  misc_feature (17)..(17): bicyclic nucleic acid (BNA)
ctgtccaagcccggttg

SEQ ID NO: 6502 - DNA, 16 bp, Artificial Sequence
  Description of Artificial Sequence: Synthetic Antisense oligonucleotide
  misc_feature (16)..(16): bicyclic nucleic acid (BNA)
ctgtccaagcccggtt

SEQ ID NO: 6503 - DNA, 15 bp, Artificial Sequence
  Description of Artificial Sequence: Synthetic Antisense oligonucleotide
  misc_feature (15)..(15): bicyclic nucleic acid (BNA)
ctgtccaagcccggt

SEQ ID NO: 6504 - DNA, 14 bp, Artificial Sequence
  Description of Artificial Sequence: Synthetic Antisense oligonucleotide
  misc_feature (14)..(14): bicyclic nucleic acid (BNA)
ctgtccaagcccgg

SEQ ID NO: 6505 - DNA, 13 bp, Artificial Sequence
  Description of Artificial Sequence: Synthetic Antisense oligonucleotide
  misc_feature (13)..(13): bicyclic nucleic acid (BNA)
ctgtccaagcccg

SEQ ID NO: 6506 - DNA, 12 bp, Artificial Sequence
  Description of Artificial Sequence: Synthetic Antisense oligonucleotide
  misc_feature (12)..(12): bicyclic nucleic acid (BNA)
ctgtccaagccc

SEQ ID NO: 6507 - DNA, 11 bp, Artificial Sequence
  Description of Artificial Sequence: Synthetic Antisense oligonucleotide
  misc_feature (11)..(11): bicyclic nucleic acid (BNA)
ctgtccaagcc

SEQ ID NO: 6508 - DNA, 10 bp, Artificial Sequence
  Description of Artificial Sequence: Synthetic Antisense oligonucleotide
  misc_feature (10)..(10): bicyclic nucleic acid (BNA)
ctgtccaagc

SEQ ID NO: 6509 - DNA, 9 bp, Artificial Sequence
  Description of Artificial Sequence: Synthetic Antisense oligonucleotide
  misc_feature (9)..(9): bicyclic nucleic acid (BNA)
ctgtccaag

SEQ ID NO: 6510 - DNA, 8 bp, Artificial Sequence
  Description of Artificial Sequence: Synthetic Antisense oligonucleotide
  misc_feature (8)..(8): bicyclic nucleic acid (BNA)
ctgtccaa

SEQ ID NO: 6511 - DNA, 20 bp, Artificial Sequence
  Description of Artificial Sequence: Synthetic Antisense oligonucleotide
  misc_feature (20)..(20): bicyclic nucleic acid (BNA)
gttctgtccaagcccggttg

SEQ ID NO: 6512 - DNA, 19 bp, Artificial Sequence
  Description of Artificial Sequence: Synthetic Antisense oligonucleotide
  misc_feature (19)..(19): bicyclic nucleic acid (BNA)
gttctgtccaagcccggtt

SEQ ID NO: 6513 - DNA, 18 bp, Artificial Sequence
  Description of Artificial Sequence: Synthetic Antisense oligonucleotide
  misc_feature (18)..(18): bicyclic nucleic acid (BNA)
gttctgtccaagcccggt

SEQ ID NO: 6514 - DNA, 17 bp, Artificial Sequence
  Description of Artificial Sequence: Synthetic Antisense oligonucleotide
  misc_feature (17)..(17): bicyclic nucleic acid (BNA)
gttctgtccaagcccgg

SEQ ID NO: 6515 - DNA, 16 bp, Artificial Sequence
  Description of Artificial Sequence: Synthetic Antisense oligonucleotide
  misc_feature (16)..(16): bicyclic nucleic acid (BNA)
gttctgtccaagcccg

SEQ ID NO: 6516 - DNA, 15 bp, Artificial Sequence
  Description of Artificial Sequence: Synthetic Antisense oligonucleotide
  misc_feature (15)..(15): bicyclic nucleic acid (BNA)
gttctgtccaagccc

SEQ ID NO: 6517 - DNA, 14 bp, Artificial Sequence
  Description of Artificial Sequence: Synthetic Antisense oligonucleotide
  misc_feature (14)..(14): bicyclic nucleic acid (BNA)
gttctgtccaagcc

SEQ ID NO: 6518 - DNA, 13 bp, Artificial Sequence
  Description of Artificial Sequence: Synthetic Antisense oligonucleotide
  misc_feature (13)..(13): bicyclic nucleic acid (BNA)
gttctgtccaagc

SEQ ID NO: 6519 - DNA, 12 bp, Artificial Sequence
  Description of Artificial Sequence: Synthetic Antisense oligonucleotide
  misc_feature (12)..(12): bicyclic nucleic acid (BNA)
gttctgtccaag

SEQ ID NO: 6520 - DNA, 11 bp, Artificial Sequence
  Description of Artificial Sequence: Synthetic Antisense oligonucleotide
  misc_feature (11)..(11): bicyclic nucleic acid (BNA)
gttctgtccaa

SEQ ID NO: 6521 - DNA, 10 bp, Artificial Sequence
  Description of Artificial Sequence: Synthetic Antisense oligonucleotide
  misc_feature (10)..(10): bicyclic nucleic acid (BNA)
gttctgtcca

SEQ ID NO: 6522 - DNA, 9 bp, Artificial Sequence
  Description of Artificial Sequence: Synthetic Antisense oligonucleotide
  misc_feature (9)..(9): bicyclic nucleic acid (BNA)
gttctgtcc

SEQ ID NO: 6523 - DNA, 8 bp, Artificial Sequence
  Description of Artificial Sequence: Synthetic Antisense oligonucleotide
  misc_feature (8)..(8): bicyclic nucleic acid (BNA)
gttctgtc

SEQ ID NO: 6524 - DNA, 20 bp, Artificial Sequence
  Description of Artificial Sequence: Synthetic Antisense oligonucleotide
  misc_feature (20)..(20): bicyclic nucleic acid (BNA)
agttctgtccaagcccggtt

SEQ ID NO: 6525 - DNA, 19 bp, Artificial Sequence
  Description of Artificial Sequence: Synthetic Antisense oligonucleotide
  misc_feature (19)..(19): bicyclic nucleic acid (BNA)
agttctgtccaagcccggt

SEQ ID NO: 6526 - DNA, 18 bp, Artificial Sequence
  Description of Artificial Sequence: Synthetic Antisense oligonucleotide
  misc_feature (18)..(18): bicyclic nucleic acid (BNA)
agttctgtccaagcccgg

SEQ ID NO: 6527 - DNA, 17 bp, Artificial Sequence
  Description of Artificial Sequence: Synthetic Antisense oligonucleotide
  misc_feature (17)..(17): bicyclic nucleic acid (BNA)
agttctgtccaagcccg

SEQ ID NO: 6528 - DNA, 16 bp, Artificial Sequence
  Description of Artificial Sequence: Synthetic Antisense oligonucleotide
  misc_feature (16)..(16): bicyclic nucleic acid (BNA)
agttctgtccaagccc

SEQ ID NO: 6529 - DNA, 15 bp, Artificial Sequence
  Description of Artificial Sequence: Synthetic Antisense oligonucleotide
  misc_feature (15)..(15): bicyclic nucleic acid (BNA)
agttctgtccaagcc

SEQ ID NO: 6530 - DNA, 14 bp, Artificial Sequence
  Description of Artificial Sequence: Synthetic Antisense oligonucleotide
  misc_feature (14)..(14): bicyclic nucleic acid (BNA)
agttctgtccaagc

SEQ ID NO: 6531 - DNA, 13 bp, Artificial Sequence
  Description of Artificial Sequence: Synthetic Antisense oligonucleotide
  misc_feature (13)..(13): bicyclic nucleic acid (BNA)
agttctgtccaag

SEQ ID NO: 6532 - DNA, 12 bp, Artificial Sequence
  Description of Artificial Sequence: Synthetic Antisense oligonucleotide
  misc_feature (12)..(12): bicyclic nucleic acid (BNA)
agttctgtccaa

SEQ ID NO: 6533 - DNA, 11 bp, Artificial Sequence
  Description of Artificial Sequence: Synthetic Antisense oligonucleotide
  misc_feature (11)..(11): bicyclic nucleic acid (BNA)
agttctgtcca

SEQ ID NO: 6534 - DNA, 10 bp, Artificial Sequence
  Description of Artificial Sequence: Synthetic Antisense oligonucleotide
  misc_feature (10)..(10): bicyclic nucleic acid (BNA)
agttctgtcc

SEQ ID NO: 6535 - DNA, 9 bp, Artificial Sequence
  Description of Artificial Sequence: Synthetic Antisense oligonucleotide
  misc_feature (9)..(9): bicyclic nucleic acid (BNA)
agttctgtc

SEQ ID NO: 6536 - DNA, 8 bp, Artificial Sequence
  Description of Artificial Sequence: Synthetic Antisense oligonucleotide
  misc_feature (8)..(8): bicyclic nucleic acid (BNA)
agttctgt

SEQ ID NO: 6537 - DNA, 20 bp, Artificial Sequence
  Description of Artificial Sequence: Synthetic Antisense oligonucleotide
  misc_feature (20)..(20): bicyclic nucleic acid (BNA)
aagttctgtccaagcccggt

SEQ ID NO: 6538 - DNA, 19 bp, Artificial Sequence
  Description of Artificial Sequence: Synthetic Antisense oligonucleotide
  misc_feature (19)..(19): bicyclic nucleic acid (BNA)
aagttctgtccaagcccgg

SEQ ID NO: 6539 - DNA, 18 bp, Artificial Sequence
  Description of Artificial Sequence: Synthetic Antisense oligonucleotide
  misc_feature (18)..(18): bicyclic nucleic acid (BNA)
aagttctgtccaagcccg

SEQ ID NO: 6540 - DNA, 17 bp, Artificial Sequence
  Description of Artificial Sequence: Synthetic Antisense oligonucleotide
  misc_feature (17)..(17): bicyclic nucleic acid (BNA)
aagttctgtccaagccc

SEQ ID NO: 6541 - DNA, 16 bp, Artificial Sequence
  Description of Artificial Sequence: Synthetic Antisense oligonucleotide
  misc_feature (16)..(16): bicyclic nucleic acid (BNA)
aagttctgtccaagcc

SEQ ID NO: 6542 - DNA, 15 bp, Artificial Sequence
  Description of Artificial Sequence: Synthetic Antisense oligonucleotide
  misc_feature (15)..(15): bicyclic nucleic acid (BNA)
aagttctgtccaagc

SEQ ID NO: 6543 - DNA, 14 bp, Artificial Sequence
  Description of Artificial Sequence: Synthetic Antisense oligonucleotide
  misc_feature (14)..(14): bicyclic nucleic acid (BNA)
aagttctgtccaag

SEQ ID NO: 6544 - DNA, 13 bp, Artificial Sequence
  Description of Artificial Sequence: Synthetic Antisense oligonucleotide
  misc_feature (13)..(13): bicyclic nucleic acid (BNA)
aagttctgtccaa

SEQ ID NO: 6545 - DNA, 12 bp, Artificial Sequence
  Description of Artificial Sequence: Synthetic Antisense oligonucleotide
  misc_feature (12)..(12): bicyclic nucleic acid (BNA)
aagttctgtcca

SEQ ID NO: 6546 - DNA, 11 bp, Artificial Sequence
  Description of Artificial Sequence: Synthetic Antisense oligonucleotide
  misc_feature (11)..(11): bicyclic nucleic acid (BNA)
aagttctgtcc

SEQ ID NO: 6547 - DNA, 10 bp, Artificial Sequence
  Description of Artificial Sequence: Synthetic Antisense oligonucleotide
  misc_feature (10)..(10): bicyclic nucleic acid (BNA)
aagttctgtc

SEQ ID NO: 6548 - DNA, 9 bp, Artificial Sequence
  Description of Artificial Sequence: Synthetic Antisense oligonucleotide
  misc_feature (9)..(9): bicyclic nucleic acid (BNA)
aagttctgt

SEQ ID NO: 6549 - DNA, 8 bp, Artificial Sequence
  Description of Artificial Sequence: Synthetic Antisense oligonucleotide
  misc_feature (8)..(8): bicyclic nucleic acid (BNA)
aagttctg

SEQ ID NO: 6550 - DNA, 20 bp, Artificial Sequence
  Description of Artificial Sequence: Synthetic Antisense oligonucleotide
  misc_feature (20)..(20): bicyclic nucleic acid (BNA)
taagttctgtccaagcccgg

SEQ ID NO: 6551 - DNA, 19 bp, Artificial Sequence
  Description of Artificial Sequence: Synthetic Antisense oligonucleotide
  misc_feature (19)..(19): bicyclic nucleic acid (BNA)
taagttctgtccaagcccg

SEQ ID NO: 6552 - DNA, 18 bp, Artificial Sequence
  Description of Artificial Sequence: Synthetic Antisense oligonucleotide
  misc_feature (18)..(18): bicyclic nucleic acid (BNA)
taagttctgtccaagccc

SEQ ID NO: 6553 - DNA, 17 bp, Artificial Sequence
  Description of Artificial Sequence: Synthetic Antisense oligonucleotide
  misc_feature (17)..(17): bicyclic nucleic acid (BNA)
taagttctgtccaagcc

SEQ ID NO: 6554 - DNA, 16 bp, Artificial Sequence
  Description of Artificial Sequence: Synthetic Antisense oligonucleotide
  misc_feature (16)..(16): bicyclic nucleic acid (BNA)
taagttctgtccaagc

SEQ ID NO: 6555 - DNA, 14 bp, Artificial Sequence
  Description of Artificial Sequence: Synthetic Antisense oligonucleotide
  misc_feature (14)..(14): bicyclic nucleic acid (BNA)
taagttctgtccaa

SEQ ID NO: 6556 - DNA, 13 bp, Artificial Sequence
  Description of Artificial Sequence: Synthetic Antisense oligonucleotide
  misc_feature (13)..(13): bicyclic nucleic acid (BNA)
taagttctgtcca

SEQ ID NO: 6557 - DNA, 12 bp, Artificial Sequence
  Description of Artificial Sequence: Synthetic Antisense oligonucleotide
  misc_feature (12)..(12): bicyclic nucleic acid (BNA)
taagttctgtcc

SEQ ID NO: 6558 - DNA, 11 bp, Artificial Sequence
  Description of Artificial Sequence: Synthetic Antisense oligonucleotide
  misc_feature (11)..(11): bicyclic nucleic acid (BNA)
taagttctgtc

SEQ ID NO: 6559 - DNA, 10 bp, Artificial Sequence
  Description of Artificial Sequence: Synthetic Antisense oligonucleotide
  misc_feature (10)..(10): bicyclic nucleic acid (BNA)
taagttctgt

SEQ ID NO: 6560 - DNA, 9 bp, Artificial Sequence
  Description of Artificial Sequence: Synthetic Antisense oligonucleotide
  misc_feature (9)..(9): bicyclic nucleic acid (BNA)
taagttctg

SEQ ID NO: 6561 - DNA, 8 bp, Artificial Sequence
  Description of Artificial Sequence: Synthetic Antisense oligonucleotide
  misc_feature (8)..(8): bicyclic nucleic acid (BNA)
taagttct

SEQ ID NO: 6562 - DNA, 20 bp, Artificial Sequence
  Description of Artificial Sequence: Synthetic Antisense oligonucleotide
  misc_feature (20)..(20): bicyclic nucleic acid (BNA)
gtaagttctgtccaagcccg

SEQ ID NO: 6563 - DNA, 19 bp, Artificial Sequence
  Description of Artificial Sequence: Synthetic Antisense oligonucleotide
  misc_feature (19)..(19): bicyclic nucleic acid (BNA)
gtaagttctgtccaagccc

SEQ ID NO: 6564 - DNA, 17 bp, Artificial Sequence
  Description of Artificial Sequence: Synthetic Antisense oligonucleotide
  misc_feature (17)..(17): bicyclic nucleic acid (BNA)
gtaagttctgtccaagc

SEQ ID NO: 6565 - DNA, 16 bp, Artificial Sequence
  Description of Artificial Sequence: Synthetic Antisense oligonucleotide
  misc_feature (16)..(16): bicyclic nucleic acid (BNA)
gtaagttctgtccaag

SEQ ID NO: 6566 - DNA, 15 bp, Artificial Sequence
  Description of Artificial Sequence: Synthetic Antisense oligonucleotide
  misc_feature (15)..(15): bicyclic nucleic acid (BNA)
gtaagttctgtccaa

SEQ ID NO: 6567 - DNA, 14 bp, Artificial Sequence
  Description of Artificial Sequence: Synthetic Antisense oligonucleotide
  misc_feature (14)..(14): bicyclic nucleic acid (BNA)
gtaagttctgtcca

SEQ ID NO: 6568 - DNA, 13 bp, Artificial Sequence
  Description of Artificial Sequence: Synthetic Antisense oligonucleotide
  misc_feature (13)..(13): bicyclic nucleic acid (BNA)
gtaagttctgtcc

SEQ ID NO: 6569 - DNA, 12 bp, Artificial Sequence
  Description of Artificial Sequence: Synthetic Antisense oligonucleotide
  misc_feature (12)..(12): bicyclic nucleic acid (BNA)
gtaagttctgtc

SEQ ID NO: 6570 - DNA, 11 bp, Artificial Sequence
  Description of Artificial Sequence: Synthetic Antisense oligonucleotide
  misc_feature (11)..(11): bicyclic nucleic acid (BNA)
gtaagttctgt

SEQ ID NO: 6571 - DNA, 10 bp, Artificial Sequence
  Description of Artificial Sequence: Synthetic Antisense oligonucleotide
  misc_feature (10)..(10): bicyclic nucleic acid (BNA)
gtaagttctg

SEQ ID NO: 6572 - DNA, 9 bp, Artificial Sequence
  Description of Artificial Sequence: Synthetic Antisense oligonucleotide
  misc_feature (9)..(9): bicyclic nucleic acid (BNA)
gtaagttct

SEQ ID NO: 6573 - DNA, 8 bp, Artificial Sequence
  Description of Artificial Sequence: Synthetic Antisense oligonucleotide
  misc_feature (8)..(8): bicyclic nucleic acid (BNA)
gtaagttc

SEQ ID NO: 6574 - DNA, 20 bp, Artificial Sequence
  Description of Artificial Sequence: Synthetic Antisense oligonucleotide
  misc_feature (20)..(20): bicyclic nucleic acid (BNA)
ggtaagttctgtccaagccc

SEQ ID NO: 6575 - DNA, 19 bp, Artificial Sequence
  Description of Artificial Sequence: Synthetic Antisense oligonucleotide
  misc_feature (19)..(19): bicyclic nucleic acid (BNA)
ggtaagttctgtccaagcc

SEQ ID NO: 6576 - DNA, 17 bp, Artificial Sequence
  Description of Artificial Sequence: Synthetic Antisense oligonucleotide
  misc_feature (17)..(17): bicyclic nucleic acid (BNA)
ggtaagttctgtccaag

SEQ ID NO: 6577 - DNA, 16 bp, Artificial Sequence
  Description of Artificial Sequence: Synthetic Antisense oligonucleotide
  misc_feature (16)..(16): bicyclic nucleic acid (BNA)
ggtaagttctgtccaa

SEQ ID NO: 6578 - DNA, 15 bp, Artificial Sequence
  Description of Artificial Sequence: Synthetic Antisense oligonucleotide
  misc_feature (15)..(15): bicyclic nucleic acid (BNA)
ggtaagttctgtcca

SEQ ID NO: 6579 - DNA, 14 bp, Artificial Sequence
  Description of Artificial Sequence: Synthetic Antisense oligonucleotide
  misc_feature (14)..(14): bicyclic nucleic acid (BNA)
ggtaagttctgtcc

SEQ ID NO: 6580 - DNA, 13 bp, Artificial Sequence
  Description of Artificial Sequence: Synthetic Antisense oligonucleotide
  misc_feature (13)..(13): bicyclic nucleic acid (BNA)
ggtaagttctgtc

SEQ ID NO: 6581 - DNA, 12 bp, Artificial Sequence
  Description of Artificial Sequence: Synthetic Antisense oligonucleotide
  misc_feature (12)..(12): bicyclic nucleic acid (BNA)
ggtaagttctgt

SEQ ID NO: 6582 - DNA, 11 bp, Artificial Sequence
  Description of Artificial Sequence: Synthetic Antisense oligonucleotide
  misc_feature (11)..(11): bicyclic nucleic acid (BNA)
ggtaagttctg

SEQ ID NO: 6583 - DNA, 10 bp, Artificial Sequence
  Description of Artificial Sequence: Synthetic Antisense oligonucleotide
  misc_feature (10)..(10): bicyclic nucleic acid (BNA)
ggtaagttct

SEQ ID NO: 6584 - DNA, 9 bp, Artificial Sequence
  Description of Artificial Sequence: Synthetic Antisense oligonucleotide
  misc_feature (9)..(9): bicyclic nucleic acid (BNA)
ggtaagttc

SEQ ID NO: 6585 - DNA, 8 bp, Artificial Sequence
  Description of Artificial Sequence: Synthetic Antisense oligonucleotide
  misc_feature (8)..(8): bicyclic nucleic acid (BNA)
ggtaagtt

SEQ ID NO: 6586 - DNA, 20 bp, Artificial Sequence
  Description of Artificial Sequence: Synthetic Antisense oligonucleotide
  misc_feature (20)..(20): bicyclic nucleic acid (BNA)
cggtaagttctgtccaagcc

SEQ ID NO: 6587 - DNA, 19 bp, Artificial Sequence
  Description of Artificial Sequence: Synthetic Antisense oligonucleotide
  misc_feature (19)..(19): bicyclic nucleic acid (BNA)
cggtaagttctgtccaagc

SEQ ID NO: 6588 - DNA, 18 bp, Artificial Sequence
  Description of Artificial Sequence: Synthetic Antisense oligonucleotide
  misc_feature (18)..(18): bicyclic nucleic acid (BNA)
cggtaagttctgtccaag

SEQ ID NO: 6589 - DNA, 17 bp, Artificial Sequence
  Description of Artificial Sequence: Synthetic Antisense oligonucleotide
  misc_feature (17)..(17): bicyclic nucleic acid (BNA)
cggtaagttctgtccaa

SEQ ID NO: 6590 - DNA, 16 bp, Artificial Sequence
  Description of Artificial Sequence: Synthetic Antisense oligonucleotide
  misc_feature (16)..(16): bicyclic nucleic acid (BNA)
cggtaagttctgtcca

SEQ ID NO: 6591 - DNA, 15 bp, Artificial Sequence
  Description of Artificial Sequence: Synthetic Antisense oligonucleotide
  misc_feature (15)..(15): bicyclic nucleic acid (BNA)
cggtaagttctgtcc

SEQ ID NO: 6592 - DNA, 14 bp, Artificial Sequence
  Description of Artificial Sequence: Synthetic Antisense oligonucleotide
  misc_feature (14)..(14): bicyclic nucleic acid (BNA)
cggtaagttctgtc

SEQ ID NO: 6593 - DNA, 13 bp, Artificial Sequence
  Description of Artificial Sequence: Synthetic Antisense oligonucleotide
  misc_feature (13)..(13): bicyclic nucleic acid (BNA)
cggtaagttctgt

SEQ ID NO: 6594 - DNA, 12 bp, Artificial Sequence
  Description of Artificial Sequence: Synthetic Antisense oligonucleotide
  misc_feature (12)..(12): bicyclic nucleic acid (BNA)
cggtaagttctg

SEQ ID NO: 6595 - DNA, 11 bp, Artificial Sequence
  Description of Artificial Sequence: Synthetic Antisense oligonucleotide
  misc_feature (11)..(11): bicyclic nucleic acid (BNA)
cggtaagttct

SEQ ID NO: 6596 - DNA, 10 bp, Artificial Sequence
  Description of Artificial Sequence: Synthetic Antisense oligonucleotide
  misc_feature (10)..(10): bicyclic nucleic acid (BNA)
cggtaagttc

SEQ ID NO: 6597 - DNA, 9 bp, Artificial Sequence
  Description of Artificial Sequence: Synthetic Antisense oligonucleotide
  misc_feature (9)..(9): bicyclic nucleic acid (BNA)
cggtaagtt

SEQ ID NO: 6598 - DNA, 8 bp, Artificial Sequence
  Description of Artificial Sequence: Synthetic Antisense oligonucleotide
  misc_feature (8)..(8): bicyclic nucleic acid (BNA)
cggtaagt

SEQ ID NO: 6599 - DNA, 20 bp, Artificial Sequence
  Description of Artificial Sequence: Synthetic Antisense oligonucleotide
  misc_feature (20)..(20): bicyclic nucleic acid (BNA)
tcggtaagttctgtccaagc

SEQ ID NO: 6600 - DNA, 19 bp, Artificial Sequence
  Description of Artificial Sequence: Synthetic Antisense oligonucleotide
  misc_feature (19)..(19): bicyclic nucleic acid (BNA)
tcggtaagttctgtccaag

SEQ ID NO: 6601 - DNA, 18 bp, Artificial Sequence
  Description of Artificial Sequence: Synthetic Antisense oligonucleotide
  misc_feature (18)..(18): bicyclic nucleic acid (BNA)
tcggtaagttctgtccaa

SEQ ID NO: 6602 - DNA, 17 bp, Artificial Sequence
  Description of Artificial Sequence: Synthetic Antisense oligonucleotide
  misc_feature (17)..(17): bicyclic nucleic acid (BNA)
tcggtaagttctgtcca

SEQ ID NO: 6603 - DNA, 16 bp, Artificial Sequence
  Description of Artificial Sequence: Synthetic Antisense oligonucleotide
  misc_feature (16)..(16): bicyclic nucleic acid (BNA)
tcggtaagttctgtcc

SEQ ID NO: 6604 - DNA, 15 bp, Artificial Sequence
  Description of Artificial Sequence: Synthetic Antisense oligonucleotide
  misc_feature (15)..(15): bicyclic nucleic acid (BNA)
tcggtaagttctgtc

SEQ ID NO: 6605 - DNA, 14 bp, Artificial Sequence
  Description of Artificial Sequence: Synthetic Antisense oligonucleotide
  misc_feature (14)..(14): bicyclic nucleic acid (BNA)
tcggtaagttctgt

SEQ ID NO: 6606 - DNA, 13 bp, Artificial Sequence
  Description of Artificial Sequence: Synthetic Antisense oligonucleotide
  misc_feature (13)..(13): bicyclic nucleic acid (BNA)
tcggtaagttctg

SEQ ID NO: 6607 - DNA, 12 bp, Artificial Sequence
  Description of Artificial Sequence: Synthetic Antisense oligonucleotide
  misc_feature (12)..(12): bicyclic nucleic acid (BNA)
tcggtaagttct

SEQ ID NO: 6608 - DNA, 11 bp, Artificial Sequence
  Description of Artificial Sequence: Synthetic Antisense oligonucleotide
  misc_feature (11)..(11): bicyclic nucleic acid (BNA)
tcggtaagttc

SEQ ID NO: 6609 - DNA, 10 bp, Artificial Sequence
  Description of Artificial Sequence: Synthetic Antisense oligonucleotide
  misc_feature (10)..(10): bicyclic nucleic acid (BNA)
tcggtaagtt

SEQ ID NO: 6610 - DNA, 9 bp, Artificial Sequence
  Description of Artificial Sequence: Synthetic Antisense oligonucleotide
  misc_feature (9)..(9): bicyclic nucleic acid (BNA)
tcggtaagt

SEQ ID NO: 6611 - DNA, 20 bp, Artificial Sequence
  Description of Artificial Sequence: Synthetic Antisense oligonucleotide
  misc_feature (20)..(20): bicyclic nucleic acid (BNA)
gtcggtaagttctgtccaag

SEQ ID NO: 6612 - DNA, 19 bp, Artificial Sequence
  Description of Artificial Sequence: Synthetic Antisense oligonucleotide
  misc_feature (19)..(19): bicyclic nucleic acid (BNA)
gtcggtaagttctgtccaa

SEQ ID NO: 6613 - DNA, 18 bp, Artificial Sequence
  Description of Artificial Sequence: Synthetic Antisense oligonucleotide
  misc_feature (18)..(18): bicyclic nucleic acid (BNA)
gtcggtaagttctgtcca

SEQ ID NO: 6614 - DNA, 17 bp, Artificial Sequence
  Description of Artificial Sequence: Synthetic Antisense oligonucleotide
  misc_feature (17)..(17): bicyclic nucleic acid (BNA)
gtcggtaagttctgtcc

SEQ ID NO: 6615 - DNA, 16 bp, Artificial Sequence
  Description of Artificial Sequence: Synthetic Antisense oligonucleotide
  misc_feature (16)..(16): bicyclic nucleic acid (BNA)
gtcggtaagttctgtc

SEQ ID NO: 6616 - DNA, 15 bp, Artificial Sequence
  Description of Artificial Sequence: Synthetic Antisense oligonucleotide
  misc_feature (15)..(15): bicyclic nucleic acid (BNA)
gtcggtaagttctgt

SEQ ID NO: 6617 - DNA, 14 bp, Artificial Sequence
  Description of Artificial Sequence: Synthetic Antisense oligonucleotide
  misc_feature (14)..(14): bicyclic nucleic acid (BNA)
gtcggtaagttctg

SEQ ID NO: 6618 - DNA, 13 bp, Artificial Sequence
  Description of Artificial Sequence: Synthetic Antisense oligonucleotide
  misc_feature (13)..(13): bicyclic nucleic acid (BNA)
gtcggtaagttct

SEQ ID NO: 6619 - DNA, 12 bp, Artificial Sequence
  Description of Artificial Sequence: Synthetic Antisense oligonucleotide
  misc_feature (12)..(12): bicyclic nucleic acid (BNA)
gtcggtaagttc

SEQ ID NO: 6620 - DNA, 11 bp, Artificial Sequence
  Description of Artificial Sequence: Synthetic Antisense oligonucleotide
  misc_feature (11)..(11): bicyclic nucleic acid (BNA)
gtcggtaagtt

SEQ ID NO: 6621 - DNA, 10 bp, Artificial Sequence
  Description of Artificial Sequence: Synthetic Antisense oligonucleotide
  misc_feature (10)..(10): bicyclic nucleic acid (BNA)
gtcggtaagt

SEQ ID NO: 6622 - DNA, 20 bp, Artificial Sequence
  Description of Artificial Sequence: Synthetic Antisense oligonucleotide
  misc_feature (20)..(20): bicyclic nucleic acid (BNA)
agtcggtaagttctgtccaa

SEQ ID NO: 6623 - DNA, 19 bp, Artificial Sequence
  Description of Artificial Sequence: Synthetic Antisense oligonucleotide
  misc_feature (19)..(19): bicyclic nucleic acid (BNA)
agtcggtaagttctgtcca

SEQ ID NO: 6624 - DNA, 17 bp, Artificial Sequence
  Description of Artificial Sequence: Synthetic Antisense oligonucleotide
  misc_feature (17)..(17): bicyclic nucleic acid (BNA)
agtcggtaagttctgtc

SEQ ID NO: 6625 - DNA, 16 bp, Artificial Sequence
  Description of Artificial Sequence: Synthetic Antisense oligonucleotide
  misc_feature (16)..(16): bicyclic nucleic acid (BNA)
agtcggtaagttctgt

SEQ ID NO: 6626 - DNA, 15 bp, Artificial Sequence
  Description of Artificial Sequence: Synthetic Antisense oligonucleotide
  misc_feature (15)..(15): bicyclic nucleic acid (BNA)
agtcggtaagttctg

SEQ ID NO: 6627 - DNA, 14 bp, Artificial Sequence
  Description of Artificial Sequence: Synthetic Antisense oligonucleotide
  misc_feature (14)..(14): bicyclic nucleic acid (BNA)
agtcggtaagttct

SEQ ID NO: 6628 - DNA, 13 bp, Artificial Sequence
  Description of Artificial Sequence: Synthetic Antisense oligonucleotide
  misc_feature (13)..(13): bicyclic nucleic acid (BNA)
agtcggtaagttc

SEQ ID NO: 6629 - DNA, 12 bp, Artificial Sequence
  Description of Artificial Sequence: Synthetic Antisense oligonucleotide
  misc_feature (12)..(12): bicyclic nucleic acid (BNA)
agtcggtaagtt

SEQ ID NO: 6630 - DNA, 11 bp, Artificial Sequence
  Description of Artificial Sequence: Synthetic Antisense oligonucleotide
  misc_feature (11)..(11): bicyclic nucleic acid (BNA)
agtcggtaagt

SEQ ID NO: 6631 - DNA, 20 bp, Artificial Sequence
  Description of Artificial Sequence: Synthetic Antisense oligonucleotide
  misc_feature (20)..(20): bicyclic nucleic acid (BNA)
cagtcggtaagttctgtcca

SEQ ID NO: 6632 - DNA, 19 bp, Artificial Sequence
  Description of Artificial Sequence: Synthetic Antisense oligonucleotide
  misc_feature (19)..(19): bicyclic nucleic acid (BNA)
cagtcggtaagttctgtcc

SEQ ID NO: 6633 - DNA, 18 bp, Artificial Sequence
  Description of Artificial Sequence: Synthetic Antisense oligonucleotide
  misc_feature (18)..(18): bicyclic nucleic acid (BNA)
cagtcggtaagttctgtc

SEQ ID NO: 6634 - DNA, 17 bp, Artificial Sequence
  Description of Artificial Sequence: Synthetic Antisense oligonucleotide
  misc_feature (17)..(17): bicyclic nucleic acid (BNA)
cagtcggtaagttctgt

SEQ ID NO: 6635 - DNA, 16 bp, Artificial Sequence
  Description of Artificial Sequence: Synthetic Antisense oligonucleotide
  misc_feature (16)..(16): bicyclic nucleic acid (BNA)
cagtcggtaagttctg

SEQ ID NO: 6636 - DNA, 15 bp, Artificial Sequence
  Description of Artificial Sequence: Synthetic Antisense oligonucleotide
  misc_feature (15)..(15): bicyclic nucleic acid (BNA)
cagtcggtaagttct

SEQ ID NO: 6637 - DNA, 14 bp, Artificial Sequence
  Description of Artificial Sequence: Synthetic Antisense oligonucleotide
  misc_feature (14)..(14): bicyclic nucleic acid (BNA)
cagtcggtaagttc

SEQ ID NO: 6638 - DNA, 13 bp, Artificial Sequence
  Description of Artificial Sequence: Synthetic Antisense oligonucleotide
  misc_feature (13)..(13): bicyclic nucleic acid (BNA)
cagtcggtaagtt

SEQ ID NO: 6639 - DNA, 12 bp, Artificial Sequence
  Description of Artificial Sequence: Synthetic Antisense oligonucleotide
  misc_feature (12)..(12): bicyclic nucleic acid (BNA)
cagtcggtaagt

SEQ ID NO: 6640 - DNA, 20 bp, Artificial Sequence
  Description of Artificial Sequence: Synthetic Antisense oligonucleotide
  misc_feature (20)..(20): bicyclic nucleic acid (BNA)
ccagtcggtaagttctgtcc

SEQ ID NO: 6641 - DNA, 19 bp, Artificial Sequence
  Description of Artificial Sequence: Synthetic Antisense oligonucleotide
  misc_feature (19)..(19): bicyclic nucleic acid (BNA)
ccagtcggtaagttctgtc

SEQ ID NO: 6642 - DNA, 18 bp, Artificial Sequence
  Description of Artificial Sequence: Synthetic Antisense oligonucleotide
  misc_feature (18)..(18): bicyclic nucleic acid (BNA)
ccagtcggtaagttctgt

SEQ ID NO: 6643 - DNA, 17 bp, Artificial Sequence
  Description of Artificial Sequence: Synthetic Antisense oligonucleotide
  misc_feature (17)..(17): bicyclic nucleic acid (BNA)
ccagtcggtaagttctg

SEQ ID NO: 6644 - DNA, 16 bp, Artificial Sequence
  Description of Artificial Sequence: Synthetic Antisense oligonucleotide
  misc_feature (16)..(16): bicyclic nucleic acid (BNA)
ccagtcggtaagttct

SEQ ID NO: 6645 - DNA, 15 bp, Artificial Sequence
  Description of Artificial Sequence: Synthetic Antisense oligonucleotide
  misc_feature (15)..(15): bicyclic nucleic acid (BNA)
ccagtcggtaagttc

SEQ ID NO: 6646 - DNA, 14 bp, Artificial Sequence
  Description of Artificial Sequence: Synthetic Antisense oligonucleotide
  misc_feature (14)..(14): bicyclic nucleic acid (BNA)
ccagtcggtaagtt

SEQ ID NO: 6647 - DNA, 13 bp, Artificial Sequence
  Description of Artificial Sequence: Synthetic Antisense oligonucleotide
  misc_feature (13)..(13): bicyclic nucleic acid (BNA)
ccagtcggtaagt

SEQ ID NO: 6648 - DNA, 20 bp, Artificial Sequence
  Description of Artificial Sequence: Synthetic Antisense oligonucleotide
  misc_feature (20)..(20): bicyclic nucleic acid (BNA)
gccagtcggtaagttctgtc

SEQ ID NO: 6649 - DNA, 19 bp, Artificial Sequence
  Description of Artificial Sequence: Synthetic Antisense oligonucleotide
  misc_feature (19)..(19): bicyclic nucleic acid (BNA)
gccagtcggtaagttctgt

SEQ ID NO: 6650 - DNA, 18 bp, Artificial Sequence
  Description of Artificial Sequence: Synthetic Antisense oligonucleotide
  misc_feature (18)..(18): bicyclic nucleic acid (BNA)
gccagtcggtaagttctg

SEQ ID NO: 6651 - DNA, 17 bp, Artificial Sequence
  Description of Artificial Sequence: Synthetic Antisense oligonucleotide
  misc_feature (17)..(17): bicyclic nucleic acid (BNA)
gccagtcggtaagttct

SEQ ID NO: 6652 - DNA, 16 bp, Artificial Sequence
  Description of Artificial Sequence: Synthetic Antisense oligonucleotide
  misc_feature (16)..(16): bicyclic nucleic acid (BNA)
gccagtcggtaagttc

SEQ ID NO: 6653 - DNA, 15 bp, Artificial Sequence
  Description of Artificial Sequence: Synthetic Antisense oligonucleotide
  misc_feature (15)..(15): bicyclic nucleic acid (BNA)
gccagtcggtaagtt

SEQ ID NO: 6654 - DNA, 14 bp, Artificial Sequence
  Description of Artificial Sequence: Synthetic Antisense oligonucleotide
  misc_feature (14)..(14): bicyclic nucleic acid (BNA)
gccagtcggtaagt

SEQ ID NO: 6655 - DNA, 20 bp, Artificial Sequence
  Description of Artificial Sequence: Synthetic Antisense oligonucleotide
  misc_feature (20)..(20): bicyclic nucleic acid (BNA)
tcaaggaagatggcatttct

SEQ ID NO: 6656 - DNA, 22 bp, Artificial Sequence
  Description of Artificial Sequence: Synthetic Antisense oligonucleotide
  misc_feature (22)..(22): bicyclic nucleic acid (BNA)
tcaaggaagatggcatttctag

SEQ ID NO: 6657 - DNA, 16 bp, Artificial Sequence
  Description of Artificial Sequence: Synthetic Antisense oligonucleotide
  misc_feature (16)..(16): bicyclic nucleic acid (BNA)
tcaaggaagatggcat

SEQ ID NO: 6658 - DNA, 15 bp, Artificial Sequence
  Description of Artificial Sequence: Synthetic Antisense oligonucleotide
  misc_feature (15)..(15): bicyclic nucleic acid (BNA)
gaagatggcatttct

SEQ ID NO: 6659 - DNA, 21 bp, Artificial Sequence
  Description of Artificial Sequence: Synthetic Antisense oligonucleotide
  misc_feature (21)..(21): bicyclic nucleic acid (BNA)
tcaaggaagatggcatttcta

SEQ ID NO: 6660 - DNA, 19 bp, Artificial Sequence
  Description of Artificial Sequence: Synthetic Antisense oligonucleotide
  misc_feature (19)..(19): bicyclic nucleic acid (BNA)
tcaaggaagatggcatttc

SEQ ID NO: 6661 - DNA, 18 bp, Artificial Sequence
  Description of Artificial Sequence: Synthetic Antisense oligonucleotide
  misc_feature (18)..(18): bicyclic nucleic acid (BNA)
tcaaggaagatggcattt

SEQ ID NO: 6662 - DNA, 17 bp, Artificial Sequence
  Description of Artificial Sequence: Synthetic Antisense oligonucleotide
  misc_feature (17)..(17): bicyclic nucleic acid (BNA)
tcaaggaagatggcatt

SEQ ID NO: 6663 - DNA, 15 bp, Artificial Sequence
  Description of Artificial Sequence: Synthetic Antisense oligonucleotide
  misc_feature (15)..(15): bicyclic nucleic acid (BNA)
tcaaggaagatggca

SEQ ID NO: 6664 - DNA, 14 bp, Artificial Sequence
  Description of Artificial Sequence: Synthetic Antisense oligonucleotide
  misc_feature (14)..(14): bicyclic nucleic acid (BNA)
tcaaggaagatggc

SEQ ID NO: 6665 - DNA, 13 bp, Artificial Sequence
  Description of Artificial Sequence: Synthetic Antisense oligonucleotide
  misc_feature (13)..(13): bicyclic nucleic acid (BNA)
tcaaggaagatgg

SEQ ID NO: 6666 - DNA, 12 bp, Artificial Sequence
  Description of Artificial Sequence: Synthetic Antisense oligonucleotide
  misc_feature (12)..(12): bicyclic nucleic acid (BNA)
tcaaggaagatg

SEQ ID NO: 6667 - DNA, 11 bp, Artificial Sequence
  Description of Artificial Sequence: Synthetic Antisense oligonucleotide
  misc_feature (11)..(11): bicyclic nucleic acid (BNA)
tcaaggaagat

SEQ ID NO: 6668 - DNA, 10 bp, Artificial Sequence
  Description of Artificial Sequence: Synthetic Antisense oligonucleotide
  misc_feature (10)..(10): bicyclic nucleic acid (BNA)
tcaaggaaga

SEQ ID NO: 6669 - DNA, 9 bp, Artificial Sequence
  Description of Artificial Sequence: Synthetic Antisense oligonucleotide
  misc_feature (9)..(9): bicyclic nucleic acid (BNA)
tcaaggaag

SEQ ID NO: 6670 - DNA, 21 bp, Artificial Sequence
  Description of Artificial Sequence: Synthetic Antisense oligonucleotide
  misc_feature (21)..(21): bicyclic nucleic acid (BNA)
caaggaagatggcatttctag

SEQ ID NO: 6671 - DNA, 20 bp, Artificial Sequence
  Description of Artificial Sequence: Synthetic Antisense oligonucleotide
  misc_feature (20)..(20): bicyclic nucleic acid (BNA)
caaggaagatggcatttcta

SEQ ID NO: 6672 - DNA, 19 bp, Artificial Sequence
  Description of Artificial Sequence: Synthetic Antisense oligonucleotide
  misc_feature (19)..(19): bicyclic nucleic acid (BNA)
caaggaagatggcatttct

SEQ ID NO: 6673 - DNA, 18 bp, Artificial Sequence
  Description of Artificial Sequence: Synthetic Antisense oligonucleotide
  misc_feature (18)..(18): bicyclic nucleic acid (BNA)
caaggaagatggcatttc

SEQ ID NO: 6674 - DNA, 17 bp, Artificial Sequence
  Description of Artificial Sequence: Synthetic Antisense oligonucleotide
  misc_feature (17)..(17): bicyclic nucleic acid (BNA)
caaggaagatggcattt

SEQ ID NO: 6675 - DNA, 16 bp, Artificial Sequence
  Description of Artificial Sequence: Synthetic Antisense oligonucleotide
  misc_feature (16)..(16): bicyclic nucleic acid (BNA)
caaggaagatggcatt

SEQ ID NO: 6676 - DNA, 15 bp, Artificial Sequence
  Description of Artificial Sequence: Synthetic Antisense oligonucleotide
  misc_feature (15)..(15): bicyclic nucleic acid (BNA)
caaggaagatggcat

SEQ ID NO: 6677 - DNA, 14 bp, Artificial Sequence
  Description of Artificial Sequence: Synthetic Antisense oligonucleotide
  misc_feature (14)..(14): bicyclic nucleic acid (BNA)
caaggaagatggca

SEQ ID NO: 6678 - DNA, 13 bp, Artificial Sequence
  Description of Artificial Sequence: Synthetic Antisense oligonucleotide
  misc_feature (13)..(13): bicyclic nucleic acid (BNA)
caaggaagatggc

SEQ ID NO: 6679 - DNA, 12 bp, Artificial Sequence
  Description of Artificial Sequence: Synthetic Antisense oligonucleotide
  misc_feature (12)..(12): bicyclic nucleic acid (BNA)
caaggaagatgg

SEQ ID NO: 6680 - DNA, 11 bp, Artificial Sequence
  Description of Artificial Sequence: Synthetic Antisense oligonucleotide
  misc_feature (11)..(11): bicyclic nucleic acid (BNA)
caaggaagatg

SEQ ID NO: 6681 - DNA, 10 bp, Artificial Sequence
  Description of Artificial Sequence: Synthetic Antisense oligonucleotide
  misc_feature (10)..(10): bicyclic nucleic acid (BNA)
caaggaagat

SEQ ID NO: 6682 - DNA, 20 bp, Artificial Sequence
  Description of Artificial Sequence: Synthetic Antisense oligonucleotide
  misc_feature (20)..(20): bicyclic nucleic acid (BNA)
aaggaagatggcatttctag

SEQ ID NO: 6683 - DNA, 19 bp, Artificial Sequence
  Description of Artificial Sequence: Synthetic Antisense oligonucleotide
  misc_feature (19)..(19): bicyclic nucleic acid (BNA)
aaggaagatggcatttcta

SEQ ID NO: 6684 - DNA, 18 bp, Artificial Sequence
  Description of Artificial Sequence: Synthetic Antisense oligonucleotide
  misc_feature (18)..(18): bicyclic nucleic acid (BNA)
aaggaagatggcatttct

SEQ ID NO: 6685 - DNA, 17 bp, Artificial Sequence
  Description of Artificial Sequence: Synthetic Antisense oligonucleotide
  misc_feature (17)..(17): bicyclic nucleic acid (BNA)
aaggaagatggcatttc

SEQ ID NO: 6686 - DNA, 16 bp, Artificial Sequence
  Description of Artificial Sequence: Synthetic Antisense oligonucleotide
  misc_feature (16)..(16): bicyclic nucleic acid (BNA)
aaggaagatggcattt

SEQ ID NO: 6687 - DNA, 15 bp, Artificial Sequence
  Description of Artificial Sequence: Synthetic Antisense oligonucleotide
  misc_feature (15)..(15): bicyclic nucleic acid (BNA)
aaggaagatggcatt

SEQ ID NO: 6688 - DNA, 14 bp, Artificial Sequence
  Description of Artificial Sequence: Synthetic Antisense oligonucleotide
  misc_feature (14)..(14): bicyclic nucleic acid (BNA)
aaggaagatggcat

SEQ ID NO: 6689 - DNA, 13 bp, Artificial Sequence
  Description of Artificial Sequence: Synthetic Antisense oligonucleotide
  misc_feature (13)..(13): bicyclic nucleic acid (BNA)
aaggaagatggca

SEQ ID NO: 6690 - DNA, 12 bp, Artificial Sequence
  Description of Artificial Sequence: Synthetic Antisense oligonucleotide
  misc_feature (12)..(12): bicyclic nucleic acid (BNA)
aaggaagatggc

SEQ ID NO: 6691 - DNA, 11 bp, Artificial Sequence
  Description of Artificial Sequence: Synthetic Antisense oligonucleotide
  misc_feature (11)..(11): bicyclic nucleic acid (BNA)
aaggaagatgg

SEQ ID NO: 6692 - DNA, 10 bp, Artificial Sequence
  Description of Artificial Sequence: Synthetic Antisense oligonucleotide
  misc_feature (10)..(10): bicyclic nucleic acid (BNA)
aaggaagatg

SEQ ID NO: 6693 - DNA, 9 bp, Artificial Sequence
  Description of Artificial Sequence: Synthetic Antisense oligonucleotide
  misc_feature (9)..(9): bicyclic nucleic acid (BNA)
aaggaagat

SEQ ID NO: 6694 - DNA, 19 bp, Artificial Sequence
  Description of Artificial Sequence: Synthetic Antisense oligonucleotide
  misc_feature (19)..(19): bicyclic nucleic acid (BNA)
aggaagatggcatttctag

SEQ ID NO: 6695 - DNA, 18 bp, Artificial Sequence
  Description of Artificial Sequence: Synthetic Antisense oligonucleotide
  misc_feature (18)..(18): bicyclic nucleic acid (BNA)
aggaagatggcatttcta

SEQ ID NO: 6696 - DNA, 17 bp, Artificial Sequence
  Description of Artificial Sequence: Synthetic Antisense oligonucleotide
  misc_feature (17)..(17): bicyclic nucleic acid (BNA)
aggaagatggcatttct

SEQ ID NO: 6697 - DNA, 16 bp, Artificial Sequence
  Description of Artificial Sequence: Synthetic Antisense oligonucleotide
  misc_feature (16)..(16): bicyclic nucleic acid (BNA)
aggaagatggcatttc

SEQ ID NO: 6698 - DNA, 15 bp, Artificial Sequence
  Description of Artificial Sequence: Synthetic Antisense oligonucleotide
  misc_feature (15)..(15): bicyclic nucleic acid (BNA)
aggaagatggcattt

SEQ ID NO: 6699 - DNA, 14 bp, Artificial Sequence
  Description of Artificial Sequence: Synthetic Antisense oligonucleotide
  misc_feature (14)..(14): bicyclic nucleic acid (BNA)
aggaagatggcatt

SEQ ID NO: 6700 - DNA, 13 bp, Artificial Sequence
  Description of Artificial Sequence: Synthetic Antisense oligonucleotide
  misc_feature (13)..(13): bicyclic nucleic acid (BNA)
aggaagatggcat

SEQ ID NO: 6701 - DNA, 12 bp, Artificial Sequence
  Description of Artificial Sequence: Synthetic Antisense oligonucleotide
  misc_feature (12)..(12): bicyclic nucleic acid (BNA)
aggaagatggca

SEQ ID NO: 6702 - DNA, 10 bp, Artificial Sequence
  Description of Artificial Sequence: Synthetic Antisense oligonucleotide
  misc_feature (10)..(10): bicyclic nucleic acid (BNA)
aggaagatgg

SEQ ID NO: 6703 - DNA, 9 bp, Artificial Sequence
  Description of Artificial Sequence: Synthetic Antisense oligonucleotide
  misc_feature (9)..(9): bicyclic nucleic acid (BNA)
aggaagatg

SEQ ID NO: 6704 - DNA, 8 bp, Artificial Sequence
  Description of Artificial Sequence: Synthetic Antisense oligonucleotide
  misc_feature (8)..(8): bicyclic nucleic acid (BNA)
aggaagat

SEQ ID NO: 6705 - DNA, 18 bp, Artificial Sequence
  Description of Artificial Sequence: Synthetic Antisense oligonucleotide
  misc_feature (18)..(18): bicyclic nucleic acid (BNA)
ggaagatggcatttctag

SEQ ID NO: 6706 - DNA, 17 bp, Artificial Sequence
  Description of Artificial Sequence: Synthetic Antisense oligonucleotide
  misc_feature (17)..(17): bicyclic nucleic acid (BNA)
ggaagatggcatttcta

SEQ ID NO: 6707 - DNA, 16 bp, Artificial Sequence
  Description of Artificial Sequence: Synthetic Antisense oligonucleotide
  misc_feature (16)..(16): bicyclic nucleic acid (BNA)
ggaagatggcatttct

SEQ ID NO: 6708 - DNA, 15 bp, Artificial Sequence
  Description of Artificial Sequence: Synthetic Antisense oligonucleotide
  misc_feature (15)..(15): bicyclic nucleic acid (BNA)
ggaagatggcatttc

SEQ ID NO: 6709 - DNA, 14 bp, Artificial Sequence
  Description of Artificial Sequence: Synthetic Antisense oligonucleotide
  misc_feature (14)..(14): bicyclic nucleic acid (BNA)
ggaagatggcattt

SEQ ID NO: 6710 - DNA, 13 bp, Artificial Sequence
  Description of Artificial Sequence: Synthetic Antisense oligonucleotide
  misc_feature (13)..(13): bicyclic nucleic acid (BNA)
ggaagatggcatt

SEQ ID NO: 6711 - DNA, 12 bp, Artificial Sequence
  Description of Artificial Sequence: Synthetic Antisense oligonucleotide
  misc_feature (12)..(12): bicyclic nucleic acid (BNA)
ggaagatggcat

SEQ ID NO: 6712 - DNA, 11 bp, Artificial Sequence
  Description of Artificial Sequence: Synthetic Antisense oligonucleotide
  misc_feature (11)..(11): bicyclic nucleic acid (BNA)
ggaagatggca

SEQ ID NO: 6713 - DNA, 10 bp, Artificial Sequence
  Description of Artificial Sequence: Synthetic Antisense oligonucleotide
  misc_feature (10)..(10): bicyclic nucleic acid (BNA)
ggaagatggc

SEQ ID NO: 6714 - DNA, 8 bp, Artificial Sequence
  Description of Artificial Sequence: Synthetic Antisense oligonucleotide
  misc_feature (8)..(8): bicyclic nucleic acid (BNA)
ggaagatg

SEQ ID NO: 6715 - DNA, 17 bp, Artificial Sequence
  Description of Artificial Sequence: Synthetic Antisense oligonucleotide
  misc_feature (17)..(17): bicyclic nucleic acid (BNA)
gaagatggcatttctag

SEQ ID NO: 6716 - DNA, 16 bp, Artificial Sequence
  Description of Artificial Sequence: Synthetic Antisense oligonucleotide
  misc_feature (16)..(16): bicyclic nucleic acid (BNA)
gaagatggcatttcta

SEQ ID NO: 6717 - DNA, 14 bp, Artificial Sequence
  Description of Artificial Sequence: Synthetic Antisense oligonucleotide
  misc_feature (14)..(14): bicyclic nucleic acid (BNA)
gaagatggcatttc

SEQ ID NO: 6718 - DNA, 13 bp, Artificial Sequence
  Description of Artificial Sequence: Synthetic Antisense oligonucleotide
  misc_feature (13)..(13): bicyclic nucleic acid (BNA)
gaagatggcattt

SEQ ID NO: 6719 - DNA, 12 bp, Artificial Sequence
  Description of Artificial Sequence: Synthetic Antisense oligonucleotide
  misc_feature (12)..(12): bicyclic nucleic acid (BNA)
gaagatggcatt

SEQ ID NO: 6720 - DNA, 11 bp, Artificial Sequence
  Description of Artificial Sequence: Synthetic Antisense oligonucleotide
  misc_feature (11)..(11): bicyclic nucleic acid (BNA)
gaagatggcat

SEQ ID NO: 6721 - DNA, 10 bp, Artificial Sequence
  Description of Artificial Sequence: Synthetic Antisense oligonucleotide
  misc_feature (10)..(10): bicyclic nucleic acid (BNA)
gaagatggca

SEQ ID NO: 6722 - DNA, 9 bp, Artificial Sequence
  Description of Artificial Sequence: Synthetic Antisense oligonucleotide
  misc_feature (9)..(9): bicyclic nucleic acid (BNA)
gaagatggc

SEQ ID NO: 6723 - DNA, 8 bp, Artificial Sequence
  Description of Artificial Sequence: Synthetic Antisense oligonucleotide
  misc_feature (8)..(8): bicyclic nucleic acid (BNA)
gaagatgg

SEQ ID NO: 6724 - DNA, 16 bp, Artificial Sequence
  Description of Artificial Sequence: Synthetic Antisense oligonucleotide
  misc_feature (16)..(16): bicyclic nucleic acid (BNA)
aagatggcatttctag

SEQ ID NO: 6725 - DNA, 15 bp, Artificial Sequence
  Description of Artificial Sequence: Synthetic Antisense oligonucleotide
  misc_feature (15)..(15): bicyclic nucleic acid (BNA)
aagatggcatttcta

SEQ ID NO: 6726 - DNA, 14 bp, Artificial Sequence
  Description of Artificial Sequence: Synthetic Antisense oligonucleotide
  misc_feature (14)..(14): bicyclic nucleic acid (BNA)
aagatggcatttct

SEQ ID NO: 6727 - DNA, 13 bp, Artificial Sequence
  Description of Artificial Sequence: Synthetic Antisense oligonucleotide
  misc_feature (13)..(13): bicyclic nucleic acid (BNA)
aagatggcatttc

SEQ ID NO: 6728 - DNA, 12 bp, Artificial Sequence
  Description of Artificial Sequence: Synthetic Antisense oligonucleotide
  misc_feature (12)..(12): bicyclic nucleic acid (BNA)
aagatggcattt

SEQ ID NO: 6729 - DNA, 11 bp, Artificial Sequence
  Description of Artificial Sequence: Synthetic Antisense oligonucleotide
  misc_feature (11)..(11): bicyclic nucleic acid (BNA)
aagatggcatt

SEQ ID NO: 6730 - DNA, 10 bp, Artificial Sequence
  Description of Artificial Sequence: Synthetic Antisense oligonucleotide
  misc_feature (10)..(10): bicyclic nucleic acid (BNA)
aagatggcat

SEQ ID NO: 6731 - DNA, 9 bp, Artificial Sequence
  Description of Artificial Sequence: Synthetic Antisense oligonucleotide
  misc_feature (9)..(9): bicyclic nucleic acid (BNA)
aagatggca

SEQ ID NO: 6732 - DNA, 8 bp, Artificial Sequence
  Description of Artificial Sequence: Synthetic Antisense oligonucleotide
  misc_feature (8)..(8): bicyclic nucleic acid (BNA)
aagatggc

SEQ ID NO: 6733 - DNA, 15 bp, Artificial Sequence
  Description of Artificial Sequence: Synthetic Antisense oligonucleotide
  misc_feature (15)..(15): bicyclic nucleic acid (BNA)
agatggcatttctag

SEQ ID NO: 6734 - DNA, 14 bp, Artificial Sequence
  Description of Artificial Sequence: Synthetic Antisense oligonucleotide
  misc_feature (14)..(14): bicyclic nucleic acid (BNA)
agatggcatttcta

SEQ ID NO: 6735 - DNA, 13 bp, Artificial Sequence
  Description of Artificial Sequence: Synthetic Antisense oligonucleotide
  misc_feature (13)..(13): bicyclic nucleic acid (BNA)
agatggcatttct

SEQ ID NO: 6736 - DNA, 12 bp, Artificial Sequence
  Description of Artificial Sequence: Synthetic Antisense oligonucleotide
  misc_feature (12)..(12): bicyclic nucleic acid (BNA)
agatggcatttc

SEQ ID NO: 6737 - DNA, 11 bp, Artificial Sequence
  Description of Artificial Sequence: Synthetic Antisense oligonucleotide
  misc_feature (11)..(11): bicyclic nucleic acid (BNA)
agatggcattt

SEQ ID NO: 6738 - DNA, 10 bp, Artificial Sequence
  Description of Artificial Sequence: Synthetic Antisense oligonucleotide
  misc_feature (10)..(10): bicyclic nucleic acid (BNA)
agatggcatt

SEQ ID NO: 6739 - DNA, 9 bp, Artificial Sequence
  Description of Artificial Sequence: Synthetic Antisense oligonucleotide
  misc_feature (9)..(9): bicyclic nucleic acid (BNA)
agatggcat

SEQ ID NO: 6740 - DNA, 8 bp, Artificial Sequence
  Description of Artificial Sequence: Synthetic Antisense oligonucleotide
  misc_feature (8)..(8): bicyclic nucleic acid (BNA)
agatggca

SEQ ID NO: 6741 - DNA, 30 bp, Artificial Sequence; identical to SEQ ID NO: 8
  Description of Artificial Sequence: Synthetic Antisense oligonucleotide
  misc_feature (30)..(30): bicyclic nucleic acid (BNA)

SEQ ID NO: 6742 - DNA, 29 bp, Artificial Sequence
  Description of Artificial Sequence: Synthetic Antisense oligonucleotide
  misc_feature (29)..(29): bicyclic nucleic acid (BNA)
ctccaacatcaaggaagatggcatttcta

SEQ ID NO: 6743 - DNA, 28 bp, Artificial Sequence
  Description of Artificial Sequence: Synthetic Antisense oligonucleotide
  misc_feature (28)..(28): bicyclic nucleic acid (BNA)
ctccaacatcaaggaagatggcatttct

SEQ ID NO: 6744 - DNA, 27 bp, Artificial Sequence
  Description of Artificial Sequence: Synthetic Antisense oligonucleotide
  misc_feature (27)..(27): bicyclic nucleic acid (BNA)
ctccaacatcaaggaagatggcatttc

SEQ ID NO: 6745 - DNA, 26 bp, Artificial Sequence
  Description of Artificial Sequence: Synthetic Antisense oligonucleotide
  misc_feature (26)..(26): bicyclic nucleic acid (BNA)
ctccaacatcaaggaagatggcattt

SEQ ID NO: 6746 - DNA, 25 bp, Artificial Sequence
  Description of Artificial Sequence: Synthetic Antisense oligonucleotide
  misc_feature (25)..(25): bicyclic nucleic acid (BNA)
ctccaacatcaaggaagatggcatt

SEQ ID NO: 6747 - DNA, 24 bp, Artificial Sequence
  Description of Artificial Sequence: Synthetic Antisense oligonucleotide
  misc_feature (24)..(24): bicyclic nucleic acid (BNA)
ctccaacatcaaggaagatggcat

SEQ ID NO: 6748 - DNA, 23 bp, Artificial Sequence
  Description of Artificial Sequence: Synthetic Antisense oligonucleotide
  misc_feature (23)..(23): bicyclic nucleic acid (BNA)
ctccaacatcaaggaagatggca

SEQ ID NO: 6749 - DNA, 22 bp, Artificial Sequence
  Description of Artificial Sequence: Synthetic Antisense oligonucleotide
  misc_feature (22)..(22): bicyclic nucleic acid (BNA)
ctccaacatcaaggaagatggc

SEQ ID NO: 6750 - DNA, 21 bp, Artificial Sequence
  Description of Artificial Sequence: Synthetic Antisense oligonucleotide
  misc_feature (21)..(21): bicyclic nucleic acid (BNA)
ctccaacatcaaggaagatgg

SEQ ID NO: 6751 - DNA, 20 bp, Artificial Sequence
  Description of Artificial Sequence: Synthetic Antisense oligonucleotide
  misc_feature (20)..(20): bicyclic nucleic acid (BNA)
ctccaacatcaaggaagatg

SEQ ID NO: 6752 - DNA, 19 bp, Artificial Sequence
  Description of Artificial Sequence: Synthetic Antisense oligonucleotide
  misc_feature (19)..(19): bicyclic nucleic acid (BNA)
ctccaacatcaaggaagat

SEQ ID NO: 6753 - DNA, 18 bp, Artificial Sequence
  Description of Artificial Sequence: Synthetic Antisense oligonucleotide
  misc_feature (18)..(18): bicyclic nucleic acid (BNA)
ctccaacatcaaggaaga

SEQ ID NO: 6754 - DNA, 17 bp, Artificial Sequence
  Description of Artificial Sequence: Synthetic Antisense oligonucleotide
  misc_feature (17)..(17): bicyclic nucleic acid (BNA)
ctccaacatcaaggaag

SEQ ID NO: 6755 - DNA, 29 bp, Artificial Sequence
  Description of Artificial Sequence: Synthetic Antisense oligonucleotide
  misc_feature (29)..(29): bicyclic nucleic acid (BNA)
tccaacatcaaggaagatggcatttctag

SEQ ID NO: 6756 - DNA, 28 bp, Artificial Sequence
  Description of Artificial Sequence: Synthetic Antisense oligonucleotide
  misc_feature (28)..(28): bicyclic nucleic acid (BNA)
tccaacatcaaggaagatggcatttcta

SEQ ID NO: 6757 - DNA, 27 bp, Artificial Sequence
  Description of Artificial Sequence: Synthetic Antisense oligonucleotide
  misc_feature (27)..(27): bicyclic nucleic acid (BNA)
tccaacatcaaggaagatggcatttct

SEQ ID NO: 6758 - DNA, 26 bp, Artificial Sequence
  Description of Artificial Sequence: Synthetic Antisense oligonucleotide
  misc_feature (26)..(26): bicyclic nucleic acid (BNA)
tccaacatcaaggaagatggcatttc

SEQ ID NO: 6759 - DNA, 25 bp, Artificial Sequence
  Description of Artificial Sequence: Synthetic Antisense oligonucleotide
  misc_feature (25)..(25): bicyclic nucleic acid (BNA)
tccaacatcaaggaagatggcattt

SEQ ID NO: 6760 - DNA, 24 bp, Artificial Sequence
  Description of Artificial Sequence: Synthetic Antisense oligonucleotide
  misc_feature (24)..(24): bicyclic nucleic acid (BNA)
tccaacatcaaggaagatggcatt

SEQ ID NO: 6761 - DNA, 23 bp, Artificial Sequence
  Description of Artificial Sequence: Synthetic Antisense oligonucleotide
  misc_feature (23)..(23): bicyclic nucleic acid (BNA)
tccaacatcaaggaagatggcat

SEQ ID NO: 6762 - DNA, 22 bp, Artificial Sequence
  Description of Artificial Sequence: Synthetic Antisense oligonucleotide
  misc_feature (22)..(22): bicyclic nucleic acid (BNA)
tccaacatcaaggaagatggca

SEQ ID NO: 6763 - DNA, 21 bp, Artificial Sequence
  Description of Artificial Sequence: Synthetic Antisense oligonucleotide
  misc_feature (21)..(21): bicyclic nucleic acid (BNA)
tccaacatcaaggaagatggc

SEQ ID NO: 6764 - DNA, 20 bp, Artificial Sequence
  Description of Artificial Sequence: Synthetic Antisense oligonucleotide
  misc_feature (20)..(20): bicyclic nucleic acid (BNA)
tccaacatcaaggaagatgg

SEQ ID NO: 6765 - DNA, 19 bp, Artificial Sequence
  Description of Artificial Sequence: Synthetic Antisense oligonucleotide
  misc_feature (19)..(19): bicyclic nucleic acid (BNA)
tccaacatcaaggaagatg

SEQ ID NO: 6766 - DNA, 18 bp, Artificial Sequence
  Description of Artificial Sequence: Synthetic Antisense oligonucleotide
  misc_feature (18)..(18): bicyclic nucleic acid (BNA)
tccaacatcaaggaagat

SEQ ID NO: 6767 - DNA, 17 bp, Artificial Sequence
  Description of Artificial Sequence: Synthetic Antisense oligonucleotide
  misc_feature (17)..(17): bicyclic nucleic acid (BNA)
tccaacatcaaggaaga

SEQ ID NO: 6768 - DNA, 16 bp, Artificial Sequence
  Description of Artificial Sequence: Synthetic Antisense oligonucleotide
  misc_feature (16)..(16): bicyclic nucleic acid (BNA)
tccaacatcaaggaag

SEQ ID NO: 6769 - DNA, 28 bp, Artificial Sequence
  Description of Artificial Sequence: Synthetic Antisense oligonucleotide
  misc_feature (28)..(28): bicyclic nucleic acid (BNA)
ccaacatcaaggaagatggcatttctag

SEQ ID NO: 6770 - DNA, 27 bp, Artificial Sequence
  Description of Artificial Sequence: Synthetic Antisense oligonucleotide
  misc_feature (27)..(27): bicyclic nucleic acid (BNA)
ccaacatcaaggaagatggcatttcta

SEQ ID NO: 6771 - DNA, 26 bp, Artificial Sequence
  Description of Artificial Sequence: Synthetic Antisense oligonucleotide
  misc_feature (26)..(26): bicyclic nucleic acid (BNA)
ccaacatcaaggaagatggcatttct

SEQ ID NO: 6772 - DNA, 25 bp, Artificial Sequence
  Description of Artificial Sequence: Synthetic Antisense oligonucleotide
  misc_feature (25)..(25): bicyclic nucleic acid (BNA)
ccaacatcaaggaagatggcatttc

SEQ ID NO: 6773 - DNA, 24 bp, Artificial Sequence
  Description of Artificial Sequence: Synthetic Antisense oligonucleotide
  misc_feature (24)..(24): bicyclic nucleic acid (BNA)
ccaacatcaaggaagatggcattt

SEQ ID NO: 6774 - DNA, 23 bp, Artificial Sequence
  Description of Artificial Sequence: Synthetic Antisense oligonucleotide
  misc_feature (23)..(23): bicyclic nucleic acid (BNA)
ccaacatcaaggaagatggcatt

SEQ ID NO: 6775 - DNA, 22 bp, Artificial Sequence
  Description of Artificial Sequence: Synthetic Antisense oligonucleotide
  misc_feature (22)..(22): bicyclic nucleic acid (BNA)
ccaacatcaaggaagatggcat

SEQ ID NO: 6776 - DNA, 21 bp, Artificial Sequence
  Description of Artificial Sequence: Synthetic Antisense oligonucleotide
  misc_feature (21)..(21): bicyclic nucleic acid (BNA)
ccaacatcaaggaagatggca

SEQ ID NO: 6777 - DNA, 20 bp, Artificial Sequence
  Description of Artificial Sequence: Synthetic Antisense oligonucleotide
  misc_feature (20)..(20): bicyclic nucleic acid (BNA)
ccaacatcaaggaagatggc

SEQ ID NO: 6778 - DNA, 19 bp, Artificial Sequence
  Description of Artificial Sequence: Synthetic Antisense oligonucleotide
  misc_feature (19)..(19): bicyclic nucleic acid (BNA)
ccaacatcaaggaagatgg

SEQ ID NO: 6779 - DNA, 18 bp, Artificial Sequence
  Description of Artificial Sequence: Synthetic Antisense oligonucleotide
  misc_feature (18)..(18): bicyclic nucleic acid (BNA)
ccaacatcaaggaagatg

SEQ ID NO: 6780 - DNA, 17 bp, Artificial Sequence
  Description of Artificial Sequence: Synthetic Antisense oligonucleotide
  misc_feature (17)..(17): bicyclic nucleic acid (BNA)
ccaacatcaaggaagat

SEQ ID NO: 6781 - DNA, 16 bp, Artificial Sequence
  Description of Artificial Sequence: Synthetic Antisense oligonucleotide
  misc_feature (16)..(16): bicyclic nucleic acid (BNA)
ccaacatcaaggaaga

SEQ ID NO: 6782 - DNA, 15 bp, Artificial Sequence
  Description of Artificial Sequence: Synthetic Antisense oligonucleotide
  misc_feature (15)..(15): bicyclic nucleic acid (BNA)
ccaacatcaaggaag

SEQ ID NO: 6783 - DNA, 27 bp, Artificial Sequence
  Description of Artificial Sequence: Synthetic Antisense oligonucleotide
  misc_feature (27)..(27): bicyclic nucleic acid (BNA)
caacatcaaggaagatggcatttctag

SEQ ID NO: 6784 - DNA, 26 bp, Artificial Sequence
  Description of Artificial Sequence: Synthetic Antisense oligonucleotide
  misc_feature (26)..(26): bicyclic nucleic acid (BNA)
caacatcaaggaagatggcatttcta

SEQ ID NO: 6785 - DNA, 25 bp, Artificial Sequence
  Description of Artificial Sequence: Synthetic Antisense oligonucleotide
  misc_feature (25)..(25): bicyclic nucleic acid (BNA)
caacatcaaggaagatggcatttct

SEQ ID NO: 6786 - DNA, 24 bp, Artificial Sequence
  Description of Artificial Sequence: Synthetic Antisense oligonucleotide
  misc_feature (24)..(24): bicyclic nucleic acid (BNA)
caacatcaaggaagatggcatttc

SEQ ID NO: 6787 - DNA, 23 bp, Artificial Sequence
  Description of Artificial Sequence: Synthetic Antisense oligonucleotide
  misc_feature (23)..(23): bicyclic nucleic acid (BNA)
caacatcaaggaagatggcattt

SEQ ID NO: 6788 - DNA, 22 bp, Artificial Sequence
  Description of Artificial Sequence: Synthetic Antisense oligonucleotide
  misc_feature (22)..(22): bicyclic nucleic acid (BNA)
caacatcaaggaagatggcatt

SEQ ID NO: 6789 - DNA, 21 bp, Artificial Sequence
  Description of Artificial Sequence: Synthetic Antisense oligonucleotide
  misc_feature (21)..(21): bicyclic nucleic acid (BNA)
caacatcaaggaagatggcat

SEQ ID NO: 6790 - DNA, 20 bp, Artificial Sequence
  Description of Artificial Sequence: Synthetic Antisense oligonucleotide
  misc_feature (20)..(20): bicyclic nucleic acid (BNA)
caacatcaaggaagatggca

SEQ ID NO: 6791 - DNA, 19 bp, Artificial Sequence
  Description of Artificial Sequence: Synthetic Antisense oligonucleotide
  misc_feature (19)..(19): bicyclic nucleic acid (BNA)
caacatcaaggaagatggc

SEQ ID NO: 6792 - DNA, 18 bp, Artificial Sequence
  Description of Artificial Sequence: Synthetic Antisense oligonucleotide
  misc_feature (18)..(18): bicyclic nucleic acid (BNA)
caacatcaaggaagatgg

SEQ ID NO: 6793 - DNA, 17 bp, Artificial Sequence
  Description of Artificial Sequence: Synthetic Antisense oligonucleotide
  misc_feature (17)..(17): bicyclic nucleic acid (BNA)
caacatcaaggaagatg

SEQ ID NO: 6794 - DNA, 16 bp, Artificial Sequence
  Description of Artificial Sequence: Synthetic Antisense oligonucleotide
  misc_feature (16)..(16): bicyclic nucleic acid (BNA)
caacatcaaggaagat

SEQ ID NO: 6795 - DNA, 15 bp, Artificial Sequence
  Description of Artificial Sequence: Synthetic Antisense oligonucleotide
  misc_feature (15)..(15): bicyclic nucleic acid (BNA)
caacatcaaggaaga

SEQ ID NO: 6796 - DNA, 14 bp, Artificial Sequence
  Description of Artificial Sequence: Synthetic Antisense oligonucleotide
  misc_feature (14)..(14): bicyclic nucleic acid (BNA)
caacatcaaggaag

SEQ ID NO: 6797 - DNA, 26 bp, Artificial Sequence
  Description of Artificial Sequence: Synthetic Antisense oligonucleotide
  misc_feature (26)..(26): bicyclic nucleic acid (BNA)
aacatcaaggaagatggcatttctag

SEQ ID NO: 6798 - DNA, 25 bp, Artificial Sequence
  Description of Artificial Sequence: Synthetic Antisense oligonucleotide
  misc_feature (25)..(25): bicyclic nucleic acid (BNA)
aacatcaaggaagatggcatttcta

SEQ ID NO: 6799 - DNA, 24 bp, Artificial Sequence
  Description of Artificial Sequence: Synthetic Antisense oligonucleotide
  misc_feature (24)..(24): bicyclic nucleic acid (BNA)
aacatcaaggaagatggcatttct

SEQ ID NO: 6800 - DNA, 23 bp, Artificial Sequence
  Description of Artificial Sequence: Synthetic Antisense oligonucleotide
  misc_feature (23)..(23): bicyclic nucleic acid (BNA)
aacatcaaggaagatggcatttc

SEQ ID NO: 6801 - DNA, 22 bp, Artificial Sequence
  Description of Artificial Sequence: Synthetic Antisense oligonucleotide
  misc_feature (22)..(22): bicyclic nucleic acid (BNA)
aacatcaaggaagatggcattt

SEQ ID NO: 6802 - DNA, 21 bp, Artificial Sequence
  Description of Artificial Sequence: Synthetic Antisense oligonucleotide
  misc_feature (21)..(21): bicyclic nucleic acid (BNA)
aacatcaaggaagatggcatt

SEQ ID NO: 6803 - DNA, 20 bp, Artificial Sequence
  Description of Artificial Sequence: Synthetic Antisense oligonucleotide
  misc_feature (20)..(20): bicyclic nucleic acid (BNA)
aacatcaaggaagatggcat

SEQ ID NO: 6804 - DNA, 19 bp, Artificial Sequence
  Description of Artificial Sequence: Synthetic Antisense oligonucleotide
  misc_feature (19)..(19): bicyclic nucleic acid (BNA)
aacatcaaggaagatggca

SEQ ID NO: 6805 - DNA, 18 bp, Artificial Sequence
  Description of Artificial Sequence: Synthetic Antisense oligonucleotide
  misc_feature (18)..(18): bicyclic nucleic acid (BNA)
aacatcaaggaagatggc

SEQ ID NO: 6806 - DNA, 17 bp, Artificial Sequence
  Description of Artificial Sequence: Synthetic Antisense oligonucleotide
  misc_feature (17)..(17): bicyclic nucleic acid (BNA)
aacatcaaggaagatgg

SEQ ID NO: 6807 - DNA, 16 bp, Artificial Sequence
  Description of Artificial Sequence: Synthetic Antisense oligonucleotide
  misc_feature (16)..(16): bicyclic nucleic acid (BNA)
aacatcaaggaagatg

SEQ ID NO: 6808 - DNA, 15 bp, Artificial Sequence
  Description of Artificial Sequence: Synthetic Antisense oligonucleotide
  misc_feature (15)..(15): bicyclic nucleic acid (BNA)
aacatcaaggaagat

SEQ ID NO: 6809 - DNA, 14 bp, Artificial Sequence
  Description of Artificial Sequence: Synthetic Antisense oligonucleotide
  misc_feature (14)..(14): bicyclic nucleic acid (BNA)
aacatcaaggaaga

SEQ ID NO: 6810 - DNA, 13 bp, Artificial Sequence
  Description of Artificial Sequence: Synthetic Antisense oligonucleotide
  misc_feature (13)..(13): bicyclic nucleic acid (BNA)
aacatcaaggaag

SEQ ID NO: 6811 - DNA, 25 bp, Artificial Sequence
  Description of Artificial Sequence: Synthetic Antisense oligonucleotide
  misc_feature (25)..(25): bicyclic nucleic acid (BNA)
acatcaaggaagatggcatttctag

SEQ ID NO: 6812 - DNA, 24 bp, Artificial Sequence
  Description of Artificial Sequence: Synthetic Antisense oligonucleotide
  misc_feature (24)..(24): bicyclic nucleic acid (BNA)
acatcaaggaagatggcatttcta

SEQ ID NO: 6813 - DNA, 23 bp, Artificial Sequence
  Description of Artificial Sequence: Synthetic Antisense oligonucleotide
  misc_feature (23)..(23): bicyclic nucleic acid (BNA)
acatcaaggaagatggcatttct

SEQ ID NO: 6814 - DNA, 22 bp, Artificial Sequence
  Description of Artificial Sequence: Synthetic Antisense oligonucleotide
  misc_feature (22)..(22): bicyclic nucleic acid (BNA)
acatcaaggaagatggcatttc

SEQ ID NO: 6815 - DNA, 21 bp, Artificial Sequence
  Description of Artificial Sequence: Synthetic Antisense oligonucleotide
  misc_feature (21)..(21): bicyclic nucleic acid (BNA)
acatcaaggaagatggcattt

SEQ ID NO: 6816 - DNA, 20 bp, Artificial Sequence
  Description of Artificial Sequence: Synthetic Antisense oligonucleotide
  misc_feature (20)..(20): bicyclic nucleic acid (BNA)
acatcaaggaagatggcatt

SEQ ID NO: 6817 - DNA, 19 bp, Artificial Sequence
  Description of Artificial Sequence: Synthetic Antisense oligonucleotide
  misc_feature (19)..(19): bicyclic nucleic acid (BNA)
acatcaaggaagatggcat

SEQ ID NO: 6818 - DNA, 18 bp, Artificial Sequence
  Description of Artificial Sequence: Synthetic Antisense oligonucleotide
  misc_feature (18)..(18): bicyclic nucleic acid (BNA)
acatcaaggaagatggca

SEQ ID NO: 6819 - DNA, 17 bp, Artificial Sequence
  Description of Artificial Sequence: Synthetic Antisense oligonucleotide
  misc_feature (17)..(17): bicyclic nucleic acid (BNA)
acatcaaggaagatggc

SEQ ID NO: 6820 - DNA, 16 bp, Artificial Sequence
  Description of Artificial Sequence: Synthetic Antisense oligonucleotide
  misc_feature (16)..(16): bicyclic nucleic acid (BNA)
acatcaaggaagatgg

SEQ ID NO: 6821 - DNA, 15 bp, Artificial Sequence
  Description of Artificial Sequence: Synthetic Antisense oligonucleotide
  misc_feature (15)..(15): bicyclic nucleic acid (BNA)
acatcaaggaagatg

SEQ ID NO: 6822 - DNA, 14 bp, Artificial Sequence
  Description of Artificial Sequence: Synthetic Antisense oligonucleotide
  misc_feature (14)..(14): bicyclic nucleic acid (BNA)
acatcaaggaagat

SEQ ID NO: 6823 - DNA, 13 bp, Artificial Sequence
  Description of Artificial Sequence: Synthetic Antisense oligonucleotide
  misc_feature (13)..(13): bicyclic nucleic acid (BNA)
acatcaaggaaga

SEQ ID NO: 6824 - DNA, 12 bp, Artificial Sequence
  Description of Artificial Sequence: Synthetic Antisense oligonucleotide
  misc_feature (12)..(12): bicyclic nucleic acid (BNA)
acatcaaggaag

SEQ ID NO: 6825 - DNA, 24 bp, Artificial Sequence
  Description of Artificial Sequence: Synthetic Antisense oligonucleotide
  misc_feature (24)..(24): bicyclic nucleic acid (BNA)
catcaaggaagatggcatttctag

SEQ ID NO: 6826 - DNA, 23 bp, Artificial Sequence
  Description of Artificial Sequence: Synthetic Antisense oligonucleotide
  misc_feature (23)..(23): bicyclic nucleic acid (BNA)
catcaaggaagatggcatttcta

SEQ ID NO: 6827 - DNA, 22 bp, Artificial Sequence
  Description of Artificial Sequence: Synthetic Antisense oligonucleotide
  misc_feature (22)..(22): bicyclic nucleic acid (BNA)
catcaaggaagatggcatttct

SEQ ID NO: 6828 - DNA, 21 bp, Artificial Sequence
  Description of Artificial Sequence: Synthetic Antisense oligonucleotide
  misc_feature (21)..(21): bicyclic nucleic acid (BNA)
catcaaggaagatggcatttc

SEQ ID NO: 6829 - DNA, 20 bp, Artificial Sequence
  Description of Artificial Sequence: Synthetic Antisense oligonucleotide
  misc_feature (20)..(20): bicyclic nucleic acid (BNA)
catcaaggaagatggcattt

SEQ ID NO: 6830 - DNA, 19 bp, Artificial Sequence
  Description of Artificial Sequence: Synthetic Antisense oligonucleotide
  misc_feature (19)..(19): bicyclic nucleic acid (BNA)
catcaaggaagatggcatt

SEQ ID NO: 6831 - DNA, 18 bp, Artificial Sequence
  Description of Artificial Sequence: Synthetic Antisense oligonucleotide
  misc_feature (18)..(18): bicyclic nucleic acid (BNA)
catcaaggaagatggcat

SEQ ID NO: 6832 - DNA, 17 bp, Artificial Sequence
  Description of Artificial Sequence: Synthetic Antisense oligonucleotide
  misc_feature (17)..(17): bicyclic nucleic acid (BNA)
catcaaggaagatggca

SEQ ID NO: 6833 - DNA, 16 bp, Artificial Sequence
  Description of Artificial Sequence: Synthetic Antisense oligonucleotide
  misc_feature (16)..(16): bicyclic nucleic acid (BNA)
catcaaggaagatggc

SEQ ID NO: 6834 - DNA, 15 bp, Artificial Sequence
  Description of Artificial Sequence: Synthetic Antisense oligonucleotide
  misc_feature (15)..(15): bicyclic nucleic acid (BNA)
catcaaggaagatgg

SEQ ID NO: 6835 - DNA, 14 bp, Artificial Sequence
  Description of Artificial Sequence: Synthetic Antisense oligonucleotide
  misc_feature (14)..(14): bicyclic nucleic acid (BNA)
catcaaggaagatg

SEQ ID NO: 6836 - DNA, 13 bp, Artificial Sequence
  Description of Artificial Sequence: Synthetic Antisense oligonucleotide
  misc_feature (13)..(13): bicyclic nucleic acid (BNA)
catcaaggaagat

SEQ ID NO: 6837 - DNA, 12 bp, Artificial Sequence
  Description of Artificial Sequence: Synthetic Antisense oligonucleotide
  misc_feature (12)..(12): bicyclic nucleic acid (BNA)
catcaaggaaga

SEQ ID NO: 6838 - DNA, 11 bp, Artificial Sequence
  Description of Artificial Sequence: Synthetic Antisense oligonucleotide
  misc_feature (11)..(11): bicyclic nucleic acid (BNA)
catcaaggaag

SEQ ID NO: 6839 - DNA, 23 bp, Artificial Sequence
  Description of Artificial Sequence: Synthetic Antisense oligonucleotide
  misc_feature (23)..(23): bicyclic nucleic acid (BNA)
atcaaggaagatggcatttctag

SEQ ID NO: 6840 - DNA, 22 bp, Artificial Sequence
  Description of Artificial Sequence: Synthetic Antisense oligonucleotide
  misc_feature (22)..(22): bicyclic nucleic acid (BNA)
atcaaggaagatggcatttcta

SEQ ID NO: 6841 - DNA, 21 bp, Artificial Sequence
  Description of Artificial Sequence: Synthetic Antisense oligonucleotide
  misc_feature (21)..(21): bicyclic nucleic acid (BNA)
atcaaggaagatggcatttct

SEQ ID NO: 6842 - DNA, 20 bp, Artificial Sequence
  Description of Artificial Sequence: Synthetic Antisense oligonucleotide
  misc_feature (20)..(20): bicyclic nucleic acid (BNA)
atcaaggaagatggcatttc

SEQ ID NO: 6843 - DNA, 19 bp, Artificial Sequence
  Description of Artificial Sequence: Synthetic Antisense oligonucleotide
  misc_feature (19)..(19): bicyclic nucleic acid (BNA)
atcaaggaagatggcattt

SEQ ID NO: 6844 - DNA, 18 bp, Artificial Sequence
  Description of Artificial Sequence: Synthetic Antisense oligonucleotide
  misc_feature (18)..(18): bicyclic nucleic acid (BNA)
atcaaggaagatggcatt

SEQ ID NO: 6845 - DNA, 17 bp, Artificial Sequence
  Description of Artificial Sequence: Synthetic Antisense oligonucleotide
  misc_feature (17)..(17): bicyclic nucleic acid (BNA)
atcaaggaagatggcat

SEQ ID NO: 6846 - DNA, 16 bp, Artificial Sequence
  Description of Artificial Sequence: Synthetic Antisense oligonucleotide
  misc_feature (16)..(16): bicyclic nucleic acid (BNA)
atcaaggaagatggca

SEQ ID NO: 6847 - DNA, 15 bp, Artificial Sequence
  Description of Artificial Sequence: Synthetic Antisense oligonucleotide
  misc_feature (15)..(15): bicyclic nucleic acid (BNA)
atcaaggaagatggc

SEQ ID NO: 6848 - DNA, 14 bp, Artificial Sequence
  Description of Artificial Sequence: Synthetic Antisense oligonucleotide
  misc_feature (14)..(14): bicyclic nucleic acid (BNA)
atcaaggaagatgg

SEQ ID NO: 6849 - DNA, 13 bp, Artificial Sequence
  Description of Artificial Sequence: Synthetic Antisense oligonucleotide
  misc_feature (13)..(13): bicyclic nucleic acid (BNA)
atcaaggaagatg

SEQ ID NO: 6850 - DNA, 12 bp, Artificial Sequence
  Description of Artificial Sequence: Synthetic Antisense oligonucleotide
  misc_feature (12)..(12): bicyclic nucleic acid (BNA)
atcaaggaagat

SEQ ID NO: 6851 - DNA, 11 bp, Artificial Sequence
  Description of Artificial Sequence: Synthetic Antisense oligonucleotide
  misc_feature (11)..(11): bicyclic nucleic acid (BNA)
atcaaggaaga

SEQ ID NO: 6852 - DNA, 10 bp, Artificial Sequence
  Description of Artificial Sequence: Synthetic Antisense oligonucleotide
  misc_feature (10)..(10): bicyclic nucleic acid (BNA)
atcaaggaag

SEQ ID NO: 6853 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
ggtaagttctgtccaagc

SEQ ID NO: 6854 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
gtaagttctgtccaagcc

SEQ ID NO: 6855 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
agtcggtaagttctgtcc

SEQ ID NO: 6856 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
ctgtccaagcccggttga

SEQ ID NO: 6857 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
taagttctgtccaag

SEQ ID NO: 6858 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
ttctgtccaagcccggttga

SEQ ID NO: 6859 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
ttctgtccaagcccggttg

SEQ ID NO: 6860 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
ttctgtccaagcccggtt

SEQ ID NO: 6861 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
ttctgtccaagcccggt

SEQ ID NO: 6862 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
ttctgtccaagcccgg

SEQ ID NO: 6863 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
ttctgtccaagcccg

SEQ ID NO: 6864 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
ttctgtccaagccc

SEQ ID NO: 6865 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
ttctgtccaagcc

SEQ ID NO: 6866 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
ttctgtccaagc

SEQ ID NO: 6867 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
ttctgtccaag

SEQ ID NO: 6868 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
ttctgtccaa

SEQ ID NO: 6869 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
ttctgtcca

SEQ ID NO: 6870 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
ttctgtcc

SEQ ID NO: 6871 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
tctgtccaagcccggttga

SEQ ID NO: 6872 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
tctgtccaagcccggttg

SEQ ID NO: 6873 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
tctgtccaagcccggtt

SEQ ID NO: 6874 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
tctgtccaagcccggt

SEQ ID NO: 6875 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
tctgtccaagcccgg

SEQ ID NO: 6876 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
tctgtccaagcccg

SEQ ID NO: 6877 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
tctgtccaagccc

SEQ ID NO: 6878 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
tctgtccaagcc

SEQ ID NO: 6879 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
tctgtccaagc

SEQ ID NO: 6880 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
tctgtccaag

SEQ ID NO: 6881 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
tctgtccaa

SEQ ID NO: 6882 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
tctgtcca

SEQ ID NO: 6883 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
ctgtccaagcccggttg

SEQ ID NO: 6884 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
ctgtccaagcccggtt

SEQ ID NO: 6885 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
ctgtccaagcccggt

SEQ ID NO: 6886 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
ctgtccaagcccgg

SEQ ID NO: 6887 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
ctgtccaagcccg

SEQ ID NO: 6888 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
ctgtccaagccc

SEQ ID NO: 6889 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
ctgtccaagcc

SEQ ID NO: 6890 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
ctgtccaagc

SEQ ID NO: 6891 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
ctgtccaag

SEQ ID NO: 6892 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
ctgtccaa

SEQ ID NO: 6893 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
gttctgtccaagcccggttg

SEQ ID NO: 6894 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
gttctgtccaagcccggtt

SEQ ID NO: 6895 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
gttctgtccaagcccggt

SEQ ID NO: 6896 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
gttctgtccaagcccgg

SEQ ID NO: 6897 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
gttctgtccaagcccg

SEQ ID NO: 6898 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
gttctgtccaagccc

SEQ ID NO: 6899 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
gttctgtccaagcc

SEQ ID NO: 6900 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
gttctgtccaagc

SEQ ID NO: 6901 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
gttctgtccaag

SEQ ID NO: 6902 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
gttctgtccaa

SEQ ID NO: 6903 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
gttctgtcca

SEQ ID NO: 6904 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
gttctgtcc

SEQ ID NO: 6905 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
gttctgtc

SEQ ID NO: 6906 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
agttctgtccaagcccggtt

SEQ ID NO: 6907 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
agttctgtccaagcccggt

SEQ ID NO: 6908 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
agttctgtccaagcccgg

SEQ ID NO: 6909 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
agttctgtccaagcccg

SEQ ID NO: 6910 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
agttctgtccaagccc

SEQ ID NO: 6911 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
agttctgtccaagcc

SEQ ID NO: 6912 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
agttctgtccaagc

SEQ ID NO: 6913 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
agttctgtccaag

SEQ ID NO: 6914 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
agttctgtccaa

SEQ ID NO: 6915 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
agttctgtcca

SEQ ID NO: 6916 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
agttctgtcc

SEQ ID NO: 6917 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
agttctgtc

SEQ ID NO: 6918 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
agttctgt

SEQ ID NO: 6919 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
aagttctgtccaagcccggt

SEQ ID NO: 6920 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
aagttctgtccaagcccgg

SEQ ID NO: 6921 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
aagttctgtccaagcccg

SEQ ID NO: 6922 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
aagttctgtccaagccc

SEQ ID NO: 6923 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
aagttctgtccaagcc

SEQ ID NO: 6924 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
aagttctgtccaagc

SEQ ID NO: 6925 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
aagttctgtccaag

SEQ ID NO: 6926 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
aagttctgtccaa

SEQ ID NO: 6927 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
aagttctgtcca

SEQ ID NO: 6928 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
aagttctgtcc

SEQ ID NO: 6929 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
aagttctgtc

SEQ ID NO: 6930 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
aagttctgt

SEQ ID NO: 6931 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
aagttctg

SEQ ID NO: 6932 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
taagttctgtccaagcccgg

SEQ ID NO: 6933 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
taagttctgtccaagcccg

SEQ ID NO: 6934 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
taagttctgtccaagccc

SEQ ID NO: 6935 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
taagttctgtccaagcc

SEQ ID NO: 6936 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
taagttctgtccaagc

SEQ ID NO: 6937 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
taagttctgtccaa

SEQ ID NO: 6938 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
taagttctgtcca

SEQ ID NO: 6939 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
taagttctgtcc

SEQ ID NO: 6940 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
taagttctgtc

SEQ ID NO: 6941 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
taagttctgt

SEQ ID NO: 6942 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
taagttctg

SEQ ID NO: 6943 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
taagttct

SEQ ID NO: 6944 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
gtaagttctgtccaagcccg

SEQ ID NO: 6945 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
gtaagttctgtccaagccc

SEQ ID NO: 6946 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
gtaagttctgtccaagc

SEQ ID NO: 6947 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
gtaagttctgtccaag

SEQ ID NO: 6948 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
gtaagttctgtccaa

SEQ ID NO: 6949 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
gtaagttctgtcca

SEQ ID NO: 6950 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
gtaagttctgtcc

SEQ ID NO: 6951 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
gtaagttctgtc

SEQ ID NO: 6952 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
gtaagttctgt

SEQ ID NO: 6953 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
gtaagttctg

SEQ ID NO: 6954 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
gtaagttct

SEQ ID NO: 6955 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
gtaagttc

SEQ ID NO: 6956 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
ggtaagttctgtccaagccc

SEQ ID NO: 6957 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
ggtaagttctgtccaagcc

SEQ ID NO: 6958 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
ggtaagttctgtccaag

SEQ ID NO: 6959 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
ggtaagttctgtccaa

SEQ ID NO: 6960 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
ggtaagttctgtcca

SEQ ID NO: 6961 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
ggtaagttctgtcc

SEQ ID NO: 6962 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
ggtaagttctgtc

SEQ ID NO: 6963 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
ggtaagttctgt

SEQ ID NO: 6964 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
ggtaagttctg

SEQ ID NO: 6965 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
ggtaagttct

SEQ ID NO: 6966 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
ggtaagttc

SEQ ID NO: 6967 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
ggtaagtt

SEQ ID NO: 6968 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
cggtaagttctgtccaagcc

SEQ ID NO: 6969 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
cggtaagttctgtccaagc

SEQ ID NO: 6970 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
cggtaagttctgtccaag

SEQ ID NO: 6971 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
cggtaagttctgtccaa

SEQ ID NO: 6972 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
cggtaagttctgtcca

SEQ ID NO: 6973 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
cggtaagttctgtcc

SEQ ID NO: 6974 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
cggtaagttctgtc

SEQ ID NO: 6975 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
cggtaagttctgt

SEQ ID NO: 6976 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
cggtaagttctg

SEQ ID NO: 6977 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
cggtaagttct

SEQ ID NO: 6978 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
cggtaagttc

SEQ ID NO: 6979 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
cggtaagtt

SEQ ID NO: 6980 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
cggtaagt

SEQ ID NO: 6981 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
tcggtaagttctgtccaagc

SEQ ID NO: 6982 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
tcggtaagttctgtccaag

SEQ ID NO: 6983 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
tcggtaagttctgtccaa

SEQ ID NO: 6984 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
tcggtaagttctgtcca

SEQ ID NO: 6985 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
tcggtaagttctgtcc

SEQ ID NO: 6986 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
tcggtaagttctgtc

SEQ ID NO: 6987 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
tcggtaagttctgt

SEQ ID NO: 6988 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
tcggtaagttctg

SEQ ID NO: 6989 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
tcggtaagttct

SEQ ID NO: 6990 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
tcggtaagttc

SEQ ID NO: 6991 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
tcggtaagtt

SEQ ID NO: 6992 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
tcggtaagt

SEQ ID NO: 6993 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
gtcggtaagttctgtccaag

SEQ ID NO: 6994 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
gtcggtaagttctgtccaa

SEQ ID NO: 6995 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
gtcggtaagttctgtcca

SEQ ID NO: 6996 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
gtcggtaagttctgtcc

SEQ ID NO: 6997 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
gtcggtaagttctgtc

SEQ ID NO: 6998 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
gtcggtaagttctgt

SEQ ID NO: 6999 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
gtcggtaagttctg

SEQ ID NO: 7000 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
gtcggtaagttct

SEQ ID NO: 7001 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
gtcggtaagttc

SEQ ID NO: 7002 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
gtcggtaagtt

SEQ ID NO: 7003 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
gtcggtaagt

SEQ ID NO: 7004 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
agtcggtaagttctgtccaa

SEQ ID NO: 7005 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
agtcggtaagttctgtcca

SEQ ID NO: 7006 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
agtcggtaagttctgtc

SEQ ID NO: 7007 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
agtcggtaagttctgt

SEQ ID NO: 7008 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
agtcggtaagttctg

SEQ ID NO: 7009 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
agtcggtaagttct

SEQ ID NO: 7010 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
agtcggtaagttc

SEQ ID NO: 7011 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
agtcggtaagtt

SEQ ID NO: 7012 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
agtcggtaagt

SEQ ID NO: 7013 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
cagtcggtaagttctgtcca

SEQ ID NO: 7014 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
cagtcggtaagttctgtcc

SEQ ID NO: 7015 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
cagtcggtaagttctgtc

SEQ ID NO: 7016 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
cagtcggtaagttctgt

SEQ ID NO: 7017 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
cagtcggtaagttctg

SEQ ID NO: 7018 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
cagtcggtaagttct

SEQ ID NO: 7019 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
cagtcggtaagttc

SEQ ID NO: 7020 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
cagtcggtaagtt

SEQ ID NO: 7021 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
cagtcggtaagt

SEQ ID NO: 7022 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
ccagtcggtaagttctgtcc

SEQ ID NO: 7023 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
ccagtcggtaagttctgtc

SEQ ID NO: 7024 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
ccagtcggtaagttctgt

SEQ ID NO: 7025 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
ccagtcggtaagttctg

SEQ ID NO: 7026 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
ccagtcggtaagttct

SEQ ID NO: 7027 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
ccagtcggtaagttc

SEQ ID NO: 7028 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
ccagtcggtaagtt

SEQ ID NO: 7029 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
ccagtcggtaagt

SEQ ID NO: 7030 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
gccagtcggtaagttctgtc

SEQ ID NO: 7031 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
gccagtcggtaagttctgt

SEQ ID NO: 7032 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
gccagtcggtaagttctg

SEQ ID NO: 7033 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
gccagtcggtaagttct

SEQ ID NO: 7034 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
gccagtcggtaagttc

SEQ ID NO: 7035 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
gccagtcggtaagtt

SEQ ID NO: 7036 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
gccagtcggtaagt

SEQ ID NO: 7037 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
tcaaggaagatggcatttct

SEQ ID NO: 7038 - DNA, 22 bp, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
tcaaggaagatggcatttctag

SEQ ID NO: 7039 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
tcaaggaagatggcat

SEQ ID NO: 7040 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
gaagatggcatttct

SEQ ID NO: 7041 - DNA, 21 bp, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
tcaaggaagatggcatttcta

SEQ ID NO: 7042 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
tcaaggaagatggcatttc

SEQ ID NO: 7043 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
tcaaggaagatggcattt

SEQ ID NO: 7044 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
tcaaggaagatggcatt

SEQ ID NO: 7045 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
tcaaggaagatggca

SEQ ID NO: 7046 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
tcaaggaagatggc

SEQ ID NO: 7047 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
tcaaggaagatgg

SEQ ID NO: 7048 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
tcaaggaagatg

SEQ ID NO: 7049 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
tcaaggaagat

SEQ ID NO: 7050 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
tcaaggaaga

SEQ ID NO: 7051 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
tcaaggaag

SEQ ID NO: 7052 - DNA, 21 bp, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
caaggaagatggcatttctag

SEQ ID NO: 7053 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
caaggaagatggcatttcta

SEQ ID NO: 7054 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
caaggaagatggcatttct

SEQ ID NO: 7055 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
caaggaagatggcatttc

SEQ ID NO: 7056 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
caaggaagatggcattt

SEQ ID NO: 7057 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
caaggaagatggcatt

SEQ ID NO: 7058 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
caaggaagatggcat

SEQ ID NO: 7059 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
caaggaagatggca

SEQ ID NO: 7060 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
caaggaagatggc

SEQ ID NO: 7061 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
caaggaagatgg

SEQ ID NO: 7062 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
caaggaagatg

SEQ ID NO: 7063 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
caaggaagat

SEQ ID NO: 7064 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
aaggaagatggcatttctag

SEQ ID NO: 7065 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
aaggaagatggcatttcta

SEQ ID NO: 7066 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
aaggaagatggcatttct

SEQ ID NO: 7067 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
aaggaagatggcatttc

SEQ ID NO: 7068 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
aaggaagatggcattt

SEQ ID NO: 7069 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
aaggaagatggcatt

SEQ ID NO: 7070 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
aaggaagatggcat

SEQ ID NO: 7071 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
aaggaagatggca

SEQ ID NO: 7072 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
aaggaagatggc

SEQ ID NO: 7073 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
aaggaagatgg

SEQ ID NO: 7074 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
aaggaagatg

SEQ ID NO: 7075 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
aaggaagat

SEQ ID NO: 7076 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
aggaagatggcatttctag

SEQ ID NO: 7077 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
aggaagatggcatttcta

SEQ ID NO: 7078 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
aggaagatggcatttct

SEQ ID NO: 7079 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
aggaagatggcatttc

SEQ ID NO: 7080 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
aggaagatggcattt

SEQ ID NO: 7081 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
aggaagatggcatt

SEQ ID NO: 7082 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
aggaagatggcat

SEQ ID NO: 7083 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
aggaagatggca

SEQ ID NO: 7084 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
aggaagatgg

SEQ ID NO: 7085 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
aggaagatg

SEQ ID NO: 7086 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
aggaagat

SEQ ID NO: 7087 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
ggaagatggcatttctag

SEQ ID NO: 7088 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
ggaagatggcatttcta

SEQ ID NO: 7089 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
ggaagatggcatttct

SEQ ID NO: 7090 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
ggaagatggcatttc

SEQ ID NO: 7091 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
ggaagatggcattt

SEQ ID NO: 7092 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
ggaagatggcatt

SEQ ID NO: 7093 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
ggaagatggcat

SEQ ID NO: 7094 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
ggaagatggca

SEQ ID NO: 7095 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
ggaagatggc

SEQ ID NO: 7096 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
ggaagatg

SEQ ID NO: 7097 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
gaagatggcatttctag

SEQ ID NO: 7098 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
gaagatggcatttcta

SEQ ID NO: 7099 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
gaagatggcatttc

SEQ ID NO: 7100 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
gaagatggcattt

SEQ ID NO: 7101 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
gaagatggcatt

SEQ ID NO: 7102 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
gaagatggcat

SEQ ID NO: 7103 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
gaagatggca

SEQ ID NO: 7104 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
gaagatggc

SEQ ID NO: 7105 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
gaagatgg

SEQ ID NO: 7106 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
aagatggcatttctag

SEQ ID NO: 7107 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
aagatggcatttcta

SEQ ID NO: 7108 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
aagatggcatttct

SEQ ID NO: 7109 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
aagatggcatttc

SEQ ID NO: 7110 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
aagatggcattt

SEQ ID NO: 7111 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
aagatggcatt

SEQ ID NO: 7112 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
aagatggcat

SEQ ID NO: 7113 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
aagatggca

SEQ ID NO: 7114 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
aagatggc

SEQ ID NO: 7115 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
agatggcatttctag

SEQ ID NO: 7116 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
agatggcatttcta

SEQ ID NO: 7117 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
agatggcatttct

SEQ ID NO: 7118 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
agatggcatttc

SEQ ID NO: 7119 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
agatggcattt

SEQ ID NO: 7120 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
agatggcatt

SEQ ID NO: 7121 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
agatggcat

SEQ ID NO: 7122 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
agatggca

SEQ ID NO: 7123 - DNA, 30 bp, Artificial Sequence; identical to SEQ ID NO: 8
  Description of Artificial Sequence: Synthetic Antisense oligonucleotide
  misc_feature (1)..(1): bicyclic nucleic acid (BNA)
  misc_feature (30)..(30): bicyclic nucleic acid (BNA)

SEQ ID NO: 7124 - DNA, 29 bp, Artificial Sequence
  Description of Artificial Sequence: Synthetic Antisense oligonucleotide
  misc_feature (1)..(1): bicyclic nucleic acid (BNA)
  misc_feature (29)..(29): bicyclic nucleic acid (BNA)
ctccaacatcaaggaagatggcatttcta

SEQ ID NO: 7125 - DNA, 28 bp, Artificial Sequence
  Description of Artificial Sequence: Synthetic Antisense oligonucleotide
  misc_feature (1)..(1): bicyclic nucleic acid (BNA)
  misc_feature (28)..(28): bicyclic nucleic acid (BNA)
ctccaacatcaaggaagatggcatttct

SEQ ID NO: 7126 - DNA, 27 bp, Artificial Sequence
  Description of Artificial Sequence: Synthetic Antisense oligonucleotide
  misc_feature (1)..(1): bicyclic nucleic acid (BNA)
  misc_feature (27)..(27): bicyclic nucleic acid (BNA)
ctccaacatcaaggaagatggcatttc

SEQ ID NO: 7127 - DNA, 26 bp, Artificial Sequence
  Description of Artificial Sequence: Synthetic Antisense oligonucleotide
  misc_feature (1)..(1): bicyclic nucleic acid (BNA)
  misc_feature (26)..(26): bicyclic nucleic acid (BNA)
ctccaacatcaaggaagatggcattt

SEQ ID NO: 7128 - DNA, 25 bp, Artificial Sequence
  Description of Artificial Sequence: Synthetic Antisense oligonucleotide
  misc_feature (1)..(1): bicyclic nucleic acid (BNA)
  misc_feature (25)..(25): bicyclic nucleic acid (BNA)
ctccaacatcaaggaagatggcatt

SEQ ID NO: 7129 - DNA, 24 bp, Artificial Sequence
  Description of Artificial Sequence: Synthetic Antisense oligonucleotide
  misc_feature (1)..(1): bicyclic nucleic acid (BNA)
  misc_feature (24)..(24): bicyclic nucleic acid (BNA)
ctccaacatcaaggaagatggcat

SEQ ID NO: 7130 - DNA, 23 bp, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
ctccaacatcaaggaagatggca

SEQ ID NO: 7131 - DNA, 22 bp, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
ctccaacatcaaggaagatggc

SEQ ID NO: 7132 - DNA, 21 bp, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
ctccaacatcaaggaagatgg

SEQ ID NO: 7133 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
ctccaacatcaaggaagatg

SEQ ID NO: 7134 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
ctccaacatcaaggaagat

SEQ ID NO: 7135 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
ctccaacatcaaggaaga

SEQ ID NO: 7136 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
ctccaacatcaaggaag

SEQ ID NO: 7137 - DNA, 29 bp, Artificial Sequence
  Description of Artificial Sequence: Synthetic Antisense oligonucleotide
  misc_feature (1)..(1): bicyclic nucleic acid (BNA)
  misc_feature (29)..(29): bicyclic nucleic acid (BNA)
tccaacatcaaggaagatggcatttctag

SEQ ID NO: 7138 - DNA, 28 bp, Artificial Sequence
  Description of Artificial Sequence: Synthetic Antisense oligonucleotide
  misc_feature (1)..(1): bicyclic nucleic acid (BNA)
  misc_feature (28)..(28): bicyclic nucleic acid (BNA)
tccaacatcaaggaagatggcatttcta

SEQ ID NO: 7139 - DNA, 27 bp, Artificial Sequence
  Description of Artificial Sequence: Synthetic Antisense oligonucleotide
  misc_feature (1)..(1): bicyclic nucleic acid (BNA)
  misc_feature (27)..(27): bicyclic nucleic acid (BNA)
tccaacatcaaggaagatggcatttct

SEQ ID NO: 7140 - DNA, 26 bp, Artificial Sequence
  Description of Artificial Sequence: Synthetic Antisense oligonucleotide
  misc_feature (1)..(1): bicyclic nucleic acid (BNA)
  misc_feature (26)..(26): bicyclic nucleic acid (BNA)
tccaacatcaaggaagatggcatttc

SEQ ID NO: 7141 - DNA, 25 bp, Artificial Sequence
  Description of Artificial Sequence: Synthetic Antisense oligonucleotide
  misc_feature (1)..(1): bicyclic nucleic acid (BNA)
  misc_feature (25)..(25): bicyclic nucleic acid (BNA)
tccaacatcaaggaagatggcattt

SEQ ID NO: 7142 - DNA, 24 bp, Artificial Sequence
  Description of Artificial Sequence: Synthetic Antisense oligonucleotide
  misc_feature (1)..(1): bicyclic nucleic acid (BNA)
  misc_feature (24)..(24): bicyclic nucleic acid (BNA)
tccaacatcaaggaagatggcatt

SEQ ID NO: 7143 - DNA, 23 bp, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
tccaacatcaaggaagatggcat

SEQ ID NO: 7144 - DNA, 22 bp, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
tccaacatcaaggaagatggca

SEQ ID NO: 7145 - DNA, 21 bp, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
tccaacatcaaggaagatggc

SEQ ID NO: 7146 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
tccaacatcaaggaagatgg

SEQ ID NO: 7147 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
tccaacatcaaggaagatg

SEQ ID NO: 7148 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
tccaacatcaaggaagat

SEQ ID NO: 7149 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
tccaacatcaaggaaga

SEQ ID NO: 7150 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
tccaacatcaaggaag

SEQ ID NO: 7151 - DNA, 28 bp, Artificial Sequence
  Description of Artificial Sequence: Synthetic Antisense oligonucleotide
  misc_feature (1)..(1): bicyclic nucleic acid (BNA)
  misc_feature (28)..(28): bicyclic nucleic acid (BNA)
ccaacatcaaggaagatggcatttctag

SEQ ID NO: 7152 - DNA, 27 bp, Artificial Sequence
  Description of Artificial Sequence: Synthetic Antisense oligonucleotide
  misc_feature (1)..(1): bicyclic nucleic acid (BNA)
  misc_feature (27)..(27): bicyclic nucleic acid (BNA)
ccaacatcaaggaagatggcatttcta

SEQ ID NO: 7153 - DNA, 26 bp, Artificial Sequence
  Description of Artificial Sequence: Synthetic Antisense oligonucleotide
  misc_feature (1)..(1): bicyclic nucleic acid (BNA)
  misc_feature (26)..(26): bicyclic nucleic acid (BNA)
ccaacatcaaggaagatggcatttct

SEQ ID NO: 7154 - DNA, 25 bp, Artificial Sequence
  Description of Artificial Sequence: Synthetic Antisense oligonucleotide
  misc_feature (1)..(1): bicyclic nucleic acid (BNA)
  misc_feature (25)..(25): bicyclic nucleic acid (BNA)
ccaacatcaaggaagatggcatttc

SEQ ID NO: 7155 - DNA, 24 bp, Artificial Sequence
  Description of Artificial Sequence: Synthetic Antisense oligonucleotide
  misc_feature (1)..(1): bicyclic nucleic acid (BNA)
  misc_feature (24)..(24): bicyclic nucleic acid (BNA)
ccaacatcaaggaagatggcattt

SEQ ID NO: 7156 - DNA, 23 bp, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
ccaacatcaaggaagatggcatt

SEQ ID NO: 7157 - DNA, 22 bp, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
ccaacatcaaggaagatggcat

SEQ ID NO: 7158 - DNA, 21 bp, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
ccaacatcaaggaagatggca

SEQ ID NO: 7159 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
ccaacatcaaggaagatggc

SEQ ID NO: 7160 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
ccaacatcaaggaagatgg

SEQ ID NO: 7161 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
ccaacatcaaggaagatg

SEQ ID NO: 7162 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
ccaacatcaaggaagat

SEQ ID NO: 7163 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
ccaacatcaaggaaga

SEQ ID NO: 7164 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
ccaacatcaaggaag

SEQ ID NO: 7165 - DNA, 27 bp, Artificial Sequence
  Description of Artificial Sequence: Synthetic Antisense oligonucleotide
  misc_feature (1)..(1): bicyclic nucleic acid (BNA)
  misc_feature (27)..(27): bicyclic nucleic acid (BNA)
caacatcaaggaagatggcatttctag

SEQ ID NO: 7166 - DNA, 26 bp, Artificial Sequence
  Description of Artificial Sequence: Synthetic Antisense oligonucleotide
  misc_feature (1)..(1): bicyclic nucleic acid (BNA)
  misc_feature (26)..(26): bicyclic nucleic acid (BNA)
caacatcaaggaagatggcatttcta

SEQ ID NO: 7167 - DNA, 25 bp, Artificial Sequence
  Description of Artificial Sequence: Synthetic Antisense oligonucleotide
  misc_feature (1)..(1): bicyclic nucleic acid (BNA)
  misc_feature (25)..(25): bicyclic nucleic acid (BNA)
caacatcaaggaagatggcatttct

SEQ ID NO: 7168 - DNA, 24 bp, Artificial Sequence
  Description of Artificial Sequence: Synthetic Antisense oligonucleotide
  misc_feature (1)..(1): bicyclic nucleic acid (BNA)
  misc_feature (24)..(24): bicyclic nucleic acid (BNA)
caacatcaaggaagatggcatttc

SEQ ID NO: 7169 - DNA, 23 bp, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
caacatcaaggaagatggcattt

SEQ ID NO: 7170 - DNA, 22 bp, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
caacatcaaggaagatggcatt

SEQ ID NO: 7171 - DNA, 21 bp, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
caacatcaaggaagatggcat

SEQ ID NO: 7172 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
caacatcaaggaagatggca

SEQ ID NO: 7173 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
caacatcaaggaagatggc

SEQ ID NO: 7174 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
caacatcaaggaagatgg

SEQ ID NO: 7175 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
caacatcaaggaagatg

SEQ ID NO: 7176 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
caacatcaaggaagat

SEQ ID NO: 7177 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
caacatcaaggaaga

SEQ ID NO: 7178 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
caacatcaaggaag

SEQ ID NO: 7179 - DNA, 26 bp, Artificial Sequence
  Description of Artificial Sequence: Synthetic Antisense oligonucleotide
  misc_feature (1)..(1): bicyclic nucleic acid (BNA)
  misc_feature (26)..(26): bicyclic nucleic acid (BNA)
aacatcaaggaagatggcatttctag

SEQ ID NO: 7180 - DNA, 25 bp, Artificial Sequence
  Description of Artificial Sequence: Synthetic Antisense oligonucleotide
  misc_feature (1)..(1): bicyclic nucleic acid (BNA)
  misc_feature (25)..(25): bicyclic nucleic acid (BNA)
aacatcaaggaagatggcatttcta

SEQ ID NO: 7181 - DNA, 24 bp, Artificial Sequence
  Description of Artificial Sequence: Synthetic Antisense oligonucleotide
  misc_feature (1)..(1): bicyclic nucleic acid (BNA)
  misc_feature (24)..(24): bicyclic nucleic acid (BNA)
aacatcaaggaagatggcatttct

SEQ ID NO: 7182 - DNA, 23 bp, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
aacatcaaggaagatggcatttc

SEQ ID NO: 7183 - DNA, 22 bp, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
aacatcaaggaagatggcattt

SEQ ID NO: 7184 - DNA, 21 bp, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
aacatcaaggaagatggcatt

SEQ ID NO: 7185 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
aacatcaaggaagatggcat

SEQ ID NO: 7186 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
aacatcaaggaagatggca

SEQ ID NO: 7187 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
aacatcaaggaagatggc

SEQ ID NO: 7188 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
aacatcaaggaagatgg

SEQ ID NO: 7189 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
aacatcaaggaagatg

SEQ ID NO: 7190 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
aacatcaaggaagat

SEQ ID NO: 7191 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
aacatcaaggaaga

SEQ ID NO: 7192 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
aacatcaaggaag

SEQ ID NO: 7193 - DNA, 25 bp, Artificial Sequence
  Description of Artificial Sequence: Synthetic Antisense oligonucleotide
  misc_feature (1)..(1): bicyclic nucleic acid (BNA)
  misc_feature (25)..(25): bicyclic nucleic acid (BNA)
acatcaaggaagatggcatttctag

SEQ ID NO: 7194 - DNA, 24 bp, Artificial Sequence
  Description of Artificial Sequence: Synthetic Antisense oligonucleotide
  misc_feature (1)..(1): bicyclic nucleic acid (BNA)
  misc_feature (24)..(24): bicyclic nucleic acid (BNA)
acatcaaggaagatggcatttcta

SEQ ID NO: 7195 - DNA, 23 bp, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
acatcaaggaagatggcatttct

SEQ ID NO: 7196 - DNA, 22 bp, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
acatcaaggaagatggcatttc

SEQ ID NO: 7197 - DNA, 21 bp, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
acatcaaggaagatggcattt

SEQ ID NO: 7198 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
acatcaaggaagatggcatt

SEQ ID NO: 7199 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
acatcaaggaagatggcat

SEQ ID NO: 7200 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
acatcaaggaagatggca

SEQ ID NO: 7201 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
acatcaaggaagatggc

SEQ ID NO: 7202 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
acatcaaggaagatgg

SEQ ID NO: 7203 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
acatcaaggaagatg

SEQ ID NO: 7204 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
acatcaaggaagat

SEQ ID NO: 7205 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
acatcaaggaaga

SEQ ID NO: 7206 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
acatcaaggaag

SEQ ID NO: 7207 - DNA, 24 bp, Artificial Sequence
  Description of Artificial Sequence: Synthetic Antisense oligonucleotide
  misc_feature (1)..(1): bicyclic nucleic acid (BNA)
  misc_feature (24)..(24): bicyclic nucleic acid (BNA)
catcaaggaagatggcatttctag

SEQ ID NO: 7208 - DNA, 23 bp, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
catcaaggaagatggcatttcta

SEQ ID NO: 7209 - DNA, 22 bp, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
catcaaggaagatggcatttct

SEQ ID NO: 7210 - DNA, 21 bp, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
catcaaggaagatggcatttc

SEQ ID NO: 7211 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
catcaaggaagatggcattt

SEQ ID NO: 7212 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
catcaaggaagatggcatt

SEQ ID NO: 7213 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
catcaaggaagatggcat

SEQ ID NO: 7214 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
catcaaggaagatggca

SEQ ID NO: 7215 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
catcaaggaagatggc

SEQ ID NO: 7216 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
catcaaggaagatgg

SEQ ID NO: 7217 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
catcaaggaagatg

SEQ ID NO: 7218 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
catcaaggaagat

SEQ ID NO: 7219 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
catcaaggaaga

SEQ ID NO: 7220 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
catcaaggaag

SEQ ID NO: 7221 - DNA, 23 bp, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
atcaaggaagatggcatttctag

SEQ ID NO: 7222 - DNA, 22 bp, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
atcaaggaagatggcatttcta

SEQ ID NO: 7223 - DNA, 21 bp, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
atcaaggaagatggcatttct

SEQ ID NO: 7224 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
atcaaggaagatggcatttc

SEQ ID NO: 7225 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
atcaaggaagatggcattt

SEQ ID NO: 7226 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
atcaaggaagatggcatt

SEQ ID NO: 7227 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
atcaaggaagatggcat

SEQ ID NO: 7228 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
atcaaggaagatggca

SEQ ID NO: 7229 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
atcaaggaagatggc

SEQ ID NO: 7230 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
atcaaggaagatgg

SEQ ID NO: 7231 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
atcaaggaagatg

SEQ ID NO: 7232 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
atcaaggaagat

SEQ ID NO: 7233 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
atcaaggaaga

SEQ ID NO: 7234 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
atcaaggaag

SEQ ID NO: 7235 - DNA, 18 bp, Artificial Sequence
  Description of Artificial Sequence: Synthetic Antisense oligonucleotide
  misc_feature (1)..(2): bicyclic nucleic acid (BNA)
ggtaagttctgtccaagc

SEQ ID NO: 7236 - DNA, 18 bp, Artificial Sequence
  Description of Artificial Sequence: Synthetic Antisense oligonucleotide
  misc_feature (1)..(2): bicyclic nucleic acid (BNA)
gtaagttctgtccaagcc

SEQ ID NO: 7237 - DNA, 18 bp, Artificial Sequence
  Description of Artificial Sequence: Synthetic Antisense oligonucleotide
  misc_feature (1)..(2): bicyclic nucleic acid (BNA)
agtcggtaagttctgtcc

SEQ ID NO: 7238 - DNA, 18 bp, Artificial Sequence
  Description of Artificial Sequence: Synthetic Antisense oligonucleotide
  misc_feature (1)..(2): bicyclic nucleic acid (BNA)
ctgtccaagcccggttga

SEQ ID NO: 7239 - DNA, 15 bp, Artificial Sequence
  Description of Artificial Sequence: Synthetic Antisense oligonucleotide
  misc_feature (1)..(2): bicyclic nucleic acid (BNA)
taagttctgtccaag

SEQ ID NO: 7240 - DNA, 20 bp, Artificial Sequence
  Description of Artificial Sequence: Synthetic Antisense oligonucleotide
  misc_feature (1)..(2): bicyclic nucleic acid (BNA)
ttctgtccaagcccggttga

SEQ ID NO: 7241 - DNA, 19 bp, Artificial Sequence
  Description of Artificial Sequence: Synthetic Antisense oligonucleotide
  misc_feature (1)..(2): bicyclic nucleic acid (BNA)
ttctgtccaagcccggttg

SEQ ID NO: 7242 - DNA, 18 bp, Artificial Sequence
  Description of Artificial Sequence: Synthetic Antisense oligonucleotide
  misc_feature (1)..(2): bicyclic nucleic acid (BNA)
ttctgtccaagcccggtt

SEQ ID NO: 7243 - DNA, 17 bp, Artificial Sequence
  Description of Artificial Sequence: Synthetic Antisense oligonucleotide
  misc_feature (1)..(2): bicyclic nucleic acid (BNA)
ttctgtccaagcccggt

SEQ ID NO: 7244 - DNA, 16 bp, Artificial Sequence
  Description of Artificial Sequence: Synthetic Antisense oligonucleotide
  misc_feature (1)..(2): bicyclic nucleic acid (BNA)
ttctgtccaagcccgg

SEQ ID NO: 7245 - DNA, 15 bp, Artificial Sequence
  Description of Artificial Sequence: Synthetic Antisense oligonucleotide
  misc_feature (1)..(2): bicyclic nucleic acid (BNA)
ttctgtccaagcccg

SEQ ID NO: 7246 - DNA, 14 bp, Artificial Sequence
  Description of Artificial Sequence: Synthetic Antisense oligonucleotide
  misc_feature (1)..(2): bicyclic nucleic acid (BNA)
ttctgtccaagccc

SEQ ID NO: 7247 - DNA, 13 bp, Artificial Sequence
  Description of Artificial Sequence: Synthetic Antisense oligonucleotide
  misc_feature (1)..(2): bicyclic nucleic acid (BNA)
ttctgtccaagcc

SEQ ID NO: 7248 - DNA, 12 bp, Artificial Sequence
  Description of Artificial Sequence: Synthetic Antisense oligonucleotide
  misc_feature (1)..(2): bicyclic nucleic acid (BNA)
ttctgtccaagc

SEQ ID NO: 7249 - DNA, 11 bp, Artificial Sequence
  Description of Artificial Sequence: Synthetic Antisense oligonucleotide
  misc_feature (1)..(2): bicyclic nucleic acid (BNA)
ttctgtccaag

SEQ ID NO: 7250 - DNA, 10 bp, Artificial Sequence
  Description of Artificial Sequence: Synthetic Antisense oligonucleotide
  misc_feature (1)..(2): bicyclic nucleic acid (BNA)
ttctgtccaa

SEQ ID NO: 7251 - DNA, 9 bp, Artificial Sequence
  Description of Artificial Sequence: Synthetic Antisense oligonucleotide
  misc_feature (1)..(2): bicyclic nucleic acid (BNA)
ttctgtcca

SEQ ID NO: 7252 - DNA, 8 bp, Artificial Sequence
  Description of Artificial Sequence: Synthetic Antisense oligonucleotide
  misc_feature (1)..(2): bicyclic nucleic acid (BNA)
ttctgtcc

SEQ ID NO: 7253 - DNA, 19 bp, Artificial Sequence
  Description of Artificial Sequence: Synthetic Antisense oligonucleotide
  misc_feature (1)..(2): bicyclic nucleic acid (BNA)
tctgtccaagcccggttga

SEQ ID NO: 7254 - DNA, 18 bp, Artificial Sequence
  Description of Artificial Sequence: Synthetic Antisense oligonucleotide
  misc_feature (1)..(2): bicyclic nucleic acid (BNA)
tctgtccaagcccggttg

SEQ ID NO: 7255 - DNA, 17 bp, Artificial Sequence
  Description of Artificial Sequence: Synthetic Antisense oligonucleotide
  misc_feature (1)..(2): bicyclic nucleic acid (BNA)
tctgtccaagcccggtt

SEQ ID NO: 7256 - DNA, 16 bp, Artificial Sequence
  Description of Artificial Sequence: Synthetic Antisense oligonucleotide
  misc_feature (1)..(2): bicyclic nucleic acid (BNA)
tctgtccaagcccggt

SEQ ID NO: 7257 - DNA, 15 bp, Artificial Sequence
  Description of Artificial Sequence: Synthetic Antisense oligonucleotide
  misc_feature (1)..(2): bicyclic nucleic acid (BNA)
tctgtccaagcccgg

SEQ ID NO: 7258 - DNA, 14 bp, Artificial Sequence
  Description of Artificial Sequence: Synthetic Antisense oligonucleotide
  misc_feature (1)..(2): bicyclic nucleic acid (BNA)
tctgtccaagcccg

SEQ ID NO: 7259 - DNA, 13 bp, Artificial Sequence
  Description of Artificial Sequence: Synthetic Antisense oligonucleotide
  misc_feature (1)..(2): bicyclic nucleic acid (BNA)
tctgtccaagccc

SEQ ID NO: 7260 - DNA, 12 bp, Artificial Sequence
  Description of Artificial Sequence: Synthetic Antisense oligonucleotide
  misc_feature (1)..(2): bicyclic nucleic acid (BNA)
tctgtccaagcc

SEQ ID NO: 7261 - DNA, 11 bp, Artificial Sequence
  Description of Artificial Sequence: Synthetic Antisense oligonucleotide
  misc_feature (1)..(2): bicyclic nucleic acid (BNA)
tctgtccaagc

SEQ ID NO: 7262 - DNA, 10 bp, Artificial Sequence
  Description of Artificial Sequence: Synthetic Antisense oligonucleotide
  misc_feature (1)..(2): bicyclic nucleic acid (BNA)
tctgtccaag

SEQ ID NO: 7263 - DNA, 9 bp, Artificial Sequence
  Description of Artificial Sequence: Synthetic Antisense oligonucleotide
  misc_feature (1)..(2): bicyclic nucleic acid (BNA)
tctgtccaa

SEQ ID NO: 7264 - DNA, 8 bp, Artificial Sequence
  Description of Artificial Sequence: Synthetic Antisense oligonucleotide
  misc_feature (1)..(2): bicyclic nucleic acid (BNA)
tctgtcca

SEQ ID NO: 7265 - DNA, 17 bp, Artificial Sequence
  Description of Artificial Sequence: Synthetic Antisense oligonucleotide
  misc_feature (1)..(2): bicyclic nucleic acid (BNA)
ctgtccaagcccggttg

SEQ ID NO: 7266 - DNA, 16 bp, Artificial Sequence
  Description of Artificial Sequence: Synthetic Antisense oligonucleotide
  misc_feature (1)..(2): bicyclic nucleic acid (BNA)
ctgtccaagcccggtt

SEQ ID NO: 7267 - DNA, 15 bp, Artificial Sequence
  Description of Artificial Sequence: Synthetic Antisense oligonucleotide
  misc_feature (1)..(2): bicyclic nucleic acid (BNA)
ctgtccaagcccggt

SEQ ID NO: 7268 - DNA, 14 bp, Artificial Sequence
  Description of Artificial Sequence: Synthetic Antisense oligonucleotide
  misc_feature (1)..(2): bicyclic nucleic acid (BNA)
ctgtccaagcccgg

SEQ ID NO: 7269 - DNA, 13 bp, Artificial Sequence
  Description of Artificial Sequence: Synthetic Antisense oligonucleotide
  misc_feature (1)..(2): bicyclic nucleic acid (BNA)
ctgtccaagcccg

SEQ ID NO: 7270 - DNA, 12 bp, Artificial Sequence
  Description of Artificial Sequence: Synthetic Antisense oligonucleotide
  misc_feature (1)..(2): bicyclic nucleic acid (BNA)
ctgtccaagccc

SEQ ID NO: 7271 - DNA, 11 bp, Artificial Sequence
  Description of Artificial Sequence: Synthetic Antisense oligonucleotide
  misc_feature (1)..(2): bicyclic nucleic acid (BNA)
ctgtccaagcc

SEQ ID NO: 7272 - DNA, 10 bp, Artificial Sequence
  Description of Artificial Sequence: Synthetic Antisense oligonucleotide
  misc_feature (1)..(2): bicyclic nucleic acid (BNA)
ctgtccaagc

SEQ ID NO: 7273 - DNA, 9 bp, Artificial Sequence
  Description of Artificial Sequence: Synthetic Antisense oligonucleotide
  misc_feature (1)..(2): bicyclic nucleic acid (BNA)
ctgtccaag

SEQ ID NO: 7274 - DNA, 8 bp, Artificial Sequence
  Description of Artificial Sequence: Synthetic Antisense oligonucleotide
  misc_feature (1)..(2): bicyclic nucleic acid (BNA)
ctgtccaa

SEQ ID NO: 7275 - DNA, 20 bp, Artificial Sequence
  Description of Artificial Sequence: Synthetic Antisense oligonucleotide
  misc_feature (1)..(2): bicyclic nucleic acid (BNA)
gttctgtccaagcccggttg

SEQ ID NO: 7276 - DNA, 19 bp, Artificial Sequence
  Description of Artificial Sequence: Synthetic Antisense oligonucleotide
  misc_feature (1)..(2): bicyclic nucleic acid (BNA)
gttctgtccaagcccggtt

SEQ ID NO: 7277 - DNA, 18 bp, Artificial Sequence
  Description of Artificial Sequence: Synthetic Antisense oligonucleotide
  misc_feature (1)..(2): bicyclic nucleic acid (BNA)
gttctgtccaagcccggt

SEQ ID NO: 7278 - DNA, 17 bp, Artificial Sequence
  Description of Artificial Sequence: Synthetic Antisense oligonucleotide
  misc_feature (1)..(2): bicyclic nucleic acid (BNA)
gttctgtccaagcccgg

SEQ ID NO: 7279 - DNA, 16 bp, Artificial Sequence
  Description of Artificial Sequence: Synthetic Antisense oligonucleotide
  misc_feature (1)..(2): bicyclic nucleic acid (BNA)
gttctgtccaagcccg

SEQ ID NO: 7280 - DNA, 15 bp, Artificial Sequence
  Description of Artificial Sequence: Synthetic Antisense oligonucleotide
  misc_feature (1)..(2): bicyclic nucleic acid (BNA)
gttctgtccaagccc

SEQ ID NO: 7281 - DNA, 14 bp, Artificial Sequence
  Description of Artificial Sequence: Synthetic Antisense oligonucleotide
  misc_feature (1)..(2): bicyclic nucleic acid (BNA)
gttctgtccaagcc

SEQ ID NO: 7282 - DNA, 13 bp, Artificial Sequence
  Description of Artificial Sequence: Synthetic Antisense oligonucleotide
  misc_feature (1)..(2): bicyclic nucleic acid (BNA)
gttctgtccaagc

SEQ ID NO: 7283 - DNA, 12 bp, Artificial Sequence
  Description of Artificial Sequence: Synthetic Antisense oligonucleotide
  misc_feature (1)..(2): bicyclic nucleic acid (BNA)
gttctgtccaag

SEQ ID NO: 7284 - DNA, 11 bp, Artificial Sequence
  Description of Artificial Sequence: Synthetic Antisense oligonucleotide
  misc_feature (1)..(2): bicyclic nucleic acid (BNA)
gttctgtccaa

SEQ ID NO: 7285 - DNA, 10 bp, Artificial Sequence
  Description of Artificial Sequence: Synthetic Antisense oligonucleotide
  misc_feature (1)..(2): bicyclic nucleic acid (BNA)
gttctgtcca

SEQ ID NO: 7286 - DNA, 9 bp, Artificial Sequence
  Description of Artificial Sequence: Synthetic Antisense oligonucleotide
  misc_feature (1)..(2): bicyclic nucleic acid (BNA)
gttctgtcc

SEQ ID NO: 7287 - DNA, 8 bp, Artificial Sequence
  Description of Artificial Sequence: Synthetic Antisense oligonucleotide
  misc_feature (1)..(2): bicyclic nucleic acid (BNA)
gttctgtc

SEQ ID NO: 7288 - DNA, 20 bp, Artificial Sequence
  Description of Artificial Sequence: Synthetic Antisense oligonucleotide
  misc_feature (1)..(2): bicyclic nucleic acid (BNA)
agttctgtccaagcccggtt

SEQ ID NO: 7289 - DNA, 19 bp, Artificial Sequence
  Description of Artificial Sequence: Synthetic Antisense oligonucleotide
  misc_feature (1)..(2): bicyclic nucleic acid (BNA)
agttctgtccaagcccggt

SEQ ID NO: 7290 - DNA, 18 bp, Artificial Sequence
  Description of Artificial Sequence: Synthetic Antisense oligonucleotide
  misc_feature (1)..(2): bicyclic nucleic acid (BNA)
agttctgtccaagcccgg

SEQ ID NO: 7291 - DNA, 17 bp, Artificial Sequence
  Description of Artificial Sequence: Synthetic Antisense oligonucleotide
  misc_feature (1)..(2): bicyclic nucleic acid (BNA)
agttctgtccaagcccg

SEQ ID NO: 7292 - DNA, 16 bp, Artificial Sequence
  Description of Artificial Sequence: Synthetic Antisense oligonucleotide
  misc_feature (1)..(2): bicyclic nucleic acid (BNA)
agttctgtccaagccc

SEQ ID NO: 7293 - DNA, 15 bp, Artificial Sequence
  Description of Artificial Sequence: Synthetic Antisense oligonucleotide
  misc_feature (1)..(2): bicyclic nucleic acid (BNA)
agttctgtccaagcc

SEQ ID NO: 7294 - DNA, 14 bp, Artificial Sequence
  Description of Artificial Sequence: Synthetic Antisense oligonucleotide
  misc_feature (1)..(2): bicyclic nucleic acid (BNA)
agttctgtccaagc

SEQ ID NO: 7295 - DNA, 13 bp, Artificial Sequence
  Description of Artificial Sequence: Synthetic Antisense oligonucleotide
  misc_feature (1)..(2): bicyclic nucleic acid (BNA)
agttctgtccaag

SEQ ID NO: 7296 - DNA, 12 bp, Artificial Sequence
  Description of Artificial Sequence: Synthetic Antisense oligonucleotide
  misc_feature (1)..(2): bicyclic nucleic acid (BNA)
agttctgtccaa

SEQ ID NO: 7297 - DNA, 11 bp, Artificial Sequence
  Description of Artificial Sequence: Synthetic Antisense oligonucleotide
  misc_feature (1)..(2): bicyclic nucleic acid (BNA)
agttctgtcca

SEQ ID NO: 7298 - DNA, 10 bp, Artificial Sequence
  Description of Artificial Sequence: Synthetic Antisense oligonucleotide
  misc_feature (1)..(2): bicyclic nucleic acid (BNA)
agttctgtcc

SEQ ID NO: 7299 - DNA, 9 bp, Artificial Sequence
  Description of Artificial Sequence: Synthetic Antisense oligonucleotide
  misc_feature (1)..(2): bicyclic nucleic acid (BNA)
agttctgtc

SEQ ID NO: 7300 - DNA, 8 bp, Artificial Sequence
  Description of Artificial Sequence: Synthetic Antisense oligonucleotide
  misc_feature (1)..(2): bicyclic nucleic acid (BNA)
agttctgt

SEQ ID NO: 7301 - DNA, 20 bp, Artificial Sequence
  Description of Artificial Sequence: Synthetic Antisense oligonucleotide
  misc_feature (1)..(2): bicyclic nucleic acid (BNA)
aagttctgtccaagcccggt

SEQ ID NO: 7302 - DNA, 19 bp, Artificial Sequence
  Description of Artificial Sequence: Synthetic Antisense oligonucleotide
  misc_feature (1)..(2): bicyclic nucleic acid (BNA)
aagttctgtccaagcccgg

SEQ ID NO: 7303 - DNA, 18 bp, Artificial Sequence
  Description of Artificial Sequence: Synthetic Antisense oligonucleotide
  misc_feature (1)..(2): bicyclic nucleic acid (BNA)
aagttctgtccaagcccg

SEQ ID NO: 7304 - DNA, 17 bp, Artificial Sequence
  Description of Artificial Sequence: Synthetic Antisense oligonucleotide
  misc_feature (1)..(2): bicyclic nucleic acid (BNA)
aagttctgtccaagccc

SEQ ID NO: 7305 - DNA, 16 bp, Artificial Sequence
  Description of Artificial Sequence: Synthetic Antisense oligonucleotide
  misc_feature (1)..(2): bicyclic nucleic acid (BNA)
aagttctgtccaagcc

SEQ ID NO: 7306 - DNA, 15 bp, Artificial Sequence
  Description of Artificial Sequence: Synthetic Antisense oligonucleotide
  misc_feature (1)..(2): bicyclic nucleic acid (BNA)
aagttctgtccaagc

SEQ ID NO: 7307 - DNA, 14 bp, Artificial Sequence
  Description of Artificial Sequence: Synthetic Antisense oligonucleotide
  misc_feature (1)..(2): bicyclic nucleic acid (BNA)
aagttctgtccaag

SEQ ID NO: 7308 - DNA, 13 bp, Artificial Sequence
  Description of Artificial Sequence: Synthetic Antisense oligonucleotide
  misc_feature (1)..(2): bicyclic nucleic acid (BNA)
aagttctgtccaa

SEQ ID NO: 7309 - DNA, 12 bp, Artificial Sequence
  Description of Artificial Sequence: Synthetic Antisense oligonucleotide
  misc_feature (1)..(2): bicyclic nucleic acid (BNA)
aagttctgtcca

SEQ ID NO: 7310 - DNA, 11 bp, Artificial Sequence
  Description of Artificial Sequence: Synthetic Antisense oligonucleotide
  misc_feature (1)..(2): bicyclic nucleic acid (BNA)
aagttctgtcc

SEQ ID NO: 7311 - DNA, 10 bp, Artificial Sequence
  Description of Artificial Sequence: Synthetic Antisense oligonucleotide
  misc_feature (1)..(2): bicyclic nucleic acid (BNA)
aagttctgtc

SEQ ID NO: 7312 - DNA, 9 bp, Artificial Sequence
  Description of Artificial Sequence: Synthetic Antisense oligonucleotide
  misc_feature (1)..(2): bicyclic nucleic acid (BNA)
aagttctgt

SEQ ID NO: 7313 - DNA, 8 bp, Artificial Sequence
  Description of Artificial Sequence: Synthetic Antisense oligonucleotide
  misc_feature (1)..(2): bicyclic nucleic acid (BNA)
aagttctg

SEQ ID NO: 7314 - DNA, 20 bp, Artificial Sequence
  Description of Artificial Sequence: Synthetic Antisense oligonucleotide
  misc_feature (1)..(2): bicyclic nucleic acid (BNA)
taagttctgtccaagcccgg

SEQ ID NO: 7315 - DNA, 19 bp, Artificial Sequence
  Description of Artificial Sequence: Synthetic Antisense oligonucleotide
  misc_feature (1)..(2): bicyclic nucleic acid (BNA)
taagttctgtccaagcccg

SEQ ID NO: 7316 - DNA, 18 bp, Artificial Sequence
  Description of Artificial Sequence: Synthetic Antisense oligonucleotide
  misc_feature (1)..(2): bicyclic nucleic acid (BNA)
taagttctgtccaagccc

SEQ ID NO: 7317 - DNA, 17 bp, Artificial Sequence
  Description of Artificial Sequence: Synthetic Antisense oligonucleotide
  misc_feature (1)..(2): bicyclic nucleic acid (BNA)
taagttctgtccaagcc

SEQ ID NO: 7318 - DNA, 16 bp, Artificial Sequence
  Description of Artificial Sequence: Synthetic Antisense oligonucleotide
  misc_feature (1)..(2): bicyclic nucleic acid (BNA)
taagttctgtccaagc

SEQ ID NO: 7319 - DNA, 14 bp, Artificial Sequence
  Description of Artificial Sequence: Synthetic Antisense oligonucleotide
  misc_feature (1)..(2): bicyclic nucleic acid (BNA)
taagttctgtccaa

SEQ ID NO: 7320 - DNA, 13 bp, Artificial Sequence
  Description of Artificial Sequence: Synthetic Antisense oligonucleotide
  misc_feature (1)..(2): bicyclic nucleic acid (BNA)
taagttctgtcca

SEQ ID NO: 7321 - DNA, 12 bp, Artificial Sequence
  Description of Artificial Sequence: Synthetic Antisense oligonucleotide
  misc_feature (1)..(2): bicyclic nucleic acid (BNA)
taagttctgtcc

SEQ ID NO: 7322 - DNA, 11 bp, Artificial Sequence
  Description of Artificial Sequence: Synthetic Antisense oligonucleotide
  misc_feature (1)..(2): bicyclic nucleic acid (BNA)
taagttctgtc

SEQ ID NO: 7323 - DNA, 10 bp, Artificial Sequence
  Description of Artificial Sequence: Synthetic Antisense oligonucleotide
  misc_feature (1)..(2): bicyclic nucleic acid (BNA)
taagttctgt

SEQ ID NO: 7324 - DNA, 9 bp, Artificial Sequence
  Description of Artificial Sequence: Synthetic Antisense oligonucleotide
  misc_feature (1)..(2): bicyclic nucleic acid (BNA)
taagttctg

SEQ ID NO: 7325 - DNA, 8 bp, Artificial Sequence
  Description of Artificial Sequence: Synthetic Antisense oligonucleotide
  misc_feature (1)..(2): bicyclic nucleic acid (BNA)
taagttct

SEQ ID NO: 7326 - DNA, 20 bp, Artificial Sequence
  Description of Artificial Sequence: Synthetic Antisense oligonucleotide
  misc_feature (1)..(2): bicyclic nucleic acid (BNA)
gtaagttctgtccaagcccg

SEQ ID NO: 7327 - DNA, 19 bp, Artificial Sequence
  Description of Artificial Sequence: Synthetic Antisense oligonucleotide
  misc_feature (1)..(2): bicyclic nucleic acid (BNA)
gtaagttctgtccaagccc

SEQ ID NO: 7328 - DNA, 17 bp, Artificial Sequence
  Description of Artificial Sequence: Synthetic Antisense oligonucleotide
  misc_feature (1)..(2): bicyclic nucleic acid (BNA)
gtaagttctgtccaagc

SEQ ID NO: 7329 - DNA, 16 bp, Artificial Sequence
  Description of Artificial Sequence: Synthetic Antisense oligonucleotide
  misc_feature (1)..(2): bicyclic nucleic acid (BNA)
gtaagttctgtccaag

SEQ ID NO: 7330 - DNA, 15 bp, Artificial Sequence
  Description of Artificial Sequence: Synthetic Antisense oligonucleotide
  misc_feature (1)..(2): bicyclic nucleic acid (BNA)
gtaagttctgtccaa

SEQ ID NO: 7331 - DNA, 14 bp, Artificial Sequence
  Description of Artificial Sequence: Synthetic Antisense oligonucleotide
  misc_feature (1)..(2): bicyclic nucleic acid (BNA)
gtaagttctgtcca

SEQ ID NO: 7332 - DNA, 13 bp, Artificial Sequence
  Description of Artificial Sequence: Synthetic Antisense oligonucleotide
  misc_feature (1)..(2): bicyclic nucleic acid (BNA)
gtaagttctgtcc

SEQ ID NO: 7333 - DNA, 12 bp, Artificial Sequence
  Description of Artificial Sequence: Synthetic Antisense oligonucleotide
  misc_feature (1)..(2): bicyclic nucleic acid (BNA)
gtaagttctgtc

SEQ ID NO: 7334 - DNA, 11 bp, Artificial Sequence
  Description of Artificial Sequence: Synthetic Antisense oligonucleotide
  misc_feature (1)..(2): bicyclic nucleic acid (BNA)
gtaagttctgt

SEQ ID NO: 7335 - DNA, 10 bp, Artificial Sequence
  Description of Artificial Sequence: Synthetic Antisense oligonucleotide
  misc_feature (1)..(2): bicyclic nucleic acid (BNA)
gtaagttctg

SEQ ID NO: 7336 - DNA, 9 bp, Artificial Sequence
  Description of Artificial Sequence: Synthetic Antisense oligonucleotide
  misc_feature (1)..(2): bicyclic nucleic acid (BNA)
gtaagttct

SEQ ID NO: 7337 - DNA, 8 bp, Artificial Sequence
  Description of Artificial Sequence: Synthetic Antisense oligonucleotide
  misc_feature (1)..(2): bicyclic nucleic acid (BNA)
gtaagttc

SEQ ID NO: 7338 - DNA, 20 bp, Artificial Sequence
  Description of Artificial Sequence: Synthetic Antisense oligonucleotide
  misc_feature (1)..(2): bicyclic nucleic acid (BNA)
ggtaagttctgtccaagccc

SEQ ID NO: 7339 - DNA, 19 bp, Artificial Sequence
  Description of Artificial Sequence: Synthetic Antisense oligonucleotide
  misc_feature (1)..(2): bicyclic nucleic acid (BNA)
ggtaagttctgtccaagcc

SEQ ID NO: 7340 - DNA, 17 bp, Artificial Sequence
  Description of Artificial Sequence: Synthetic Antisense oligonucleotide
  misc_feature (1)..(2): bicyclic nucleic acid (BNA)
ggtaagttctgtccaag

SEQ ID NO: 7341 - DNA, 16 bp, Artificial Sequence
  Description of Artificial Sequence: Synthetic Antisense oligonucleotide
  misc_feature (1)..(2): bicyclic nucleic acid (BNA)
ggtaagttctgtccaa

SEQ ID NO: 7342 - DNA, 15 bp, Artificial Sequence
  Description of Artificial Sequence: Synthetic Antisense oligonucleotide
  misc_feature (1)..(2): bicyclic nucleic acid (BNA)
ggtaagttctgtcca

SEQ ID NO: 7343 - DNA, 14 bp, Artificial Sequence
  Description of Artificial Sequence: Synthetic Antisense oligonucleotide
  misc_feature (1)..(2): bicyclic nucleic acid (BNA)
ggtaagttctgtcc

SEQ ID NO: 7344 - DNA, 13 bp, Artificial Sequence
  Description of Artificial Sequence: Synthetic Antisense oligonucleotide
  misc_feature (1)..(2): bicyclic nucleic acid (BNA)
ggtaagttctgtc

SEQ ID NO: 7345 - DNA, 12 bp, Artificial Sequence
  Description of Artificial Sequence: Synthetic Antisense oligonucleotide
  misc_feature (1)..(2): bicyclic nucleic acid (BNA)
ggtaagttctgt

SEQ ID NO: 7346 - DNA, 11 bp, Artificial Sequence
  Description of Artificial Sequence: Synthetic Antisense oligonucleotide
  misc_feature (1)..(2): bicyclic nucleic acid (BNA)
ggtaagttctg

SEQ ID NO: 7347 - DNA, 10 bp, Artificial Sequence
  Description of Artificial Sequence: Synthetic Antisense oligonucleotide
  misc_feature (1)..(2): bicyclic nucleic acid (BNA)
ggtaagttct

SEQ ID NO: 7348 - DNA, 9 bp, Artificial Sequence
  Description of Artificial Sequence: Synthetic Antisense oligonucleotide
  misc_feature (1)..(2): bicyclic nucleic acid (BNA)
ggtaagttc

SEQ ID NO: 7349 - DNA, 8 bp, Artificial Sequence
  Description of Artificial Sequence: Synthetic Antisense oligonucleotide
  misc_feature (1)..(2): bicyclic nucleic acid (BNA)
ggtaagtt

SEQ ID NO: 7350 - DNA, 20 bp, Artificial Sequence
  Description of Artificial Sequence: Synthetic Antisense oligonucleotide
  misc_feature (1)..(2): bicyclic nucleic acid (BNA)
cggtaagttctgtccaagcc

SEQ ID NO: 7351 - DNA, 19 bp, Artificial Sequence
  Description of Artificial Sequence: Synthetic Antisense oligonucleotide
  misc_feature (1)..(2): bicyclic nucleic acid (BNA)
cggtaagttctgtccaagc

SEQ ID NO: 7352 - DNA, 18 bp, Artificial Sequence
  Description of Artificial Sequence: Synthetic Antisense oligonucleotide
  misc_feature (1)..(2): bicyclic nucleic acid (BNA)
cggtaagttctgtccaag

SEQ ID NO: 7353 - DNA, 17 bp, Artificial Sequence
  Description of Artificial Sequence: Synthetic Antisense oligonucleotide
  misc_feature (1)..(2): bicyclic nucleic acid (BNA)
cggtaagttctgtccaa

SEQ ID NO: 7354 - DNA, 16 bp, Artificial Sequence
  Description of Artificial Sequence: Synthetic Antisense oligonucleotide
  misc_feature (1)..(2): bicyclic nucleic acid (BNA)
cggtaagttctgtcca

SEQ ID NO: 7355 - DNA, 15 bp, Artificial Sequence
  Description of Artificial Sequence: Synthetic Antisense oligonucleotide
  misc_feature (1)..(2): bicyclic nucleic acid (BNA)
cggtaagttctgtcc

SEQ ID NO: 7356 - DNA, 14 bp, Artificial Sequence
  Description of Artificial Sequence: Synthetic Antisense oligonucleotide
  misc_feature (1)..(2): bicyclic nucleic acid (BNA)
cggtaagttctgtc

SEQ ID NO: 7357 - DNA, 13 bp, Artificial Sequence
  Description of Artificial Sequence: Synthetic Antisense oligonucleotide
  misc_feature (1)..(2): bicyclic nucleic acid (BNA)
cggtaagttctgt

SEQ ID NO: 7358 - DNA, 12 bp, Artificial Sequence
  Description of Artificial Sequence: Synthetic Antisense oligonucleotide
  misc_feature (1)..(2): bicyclic nucleic acid (BNA)
cggtaagttctg

SEQ ID NO: 7359 - DNA, 11 bp, Artificial Sequence
  Description of Artificial Sequence: Synthetic Antisense oligonucleotide
  misc_feature (1)..(2): bicyclic nucleic acid (BNA)
cggtaagttct

SEQ ID NO: 7360 - DNA, 10 bp, Artificial Sequence
  Description of Artificial Sequence: Synthetic Antisense oligonucleotide
  misc_feature (1)..(2): bicyclic nucleic acid (BNA)
cggtaagttc

SEQ ID NO: 7361 - DNA, 9 bp, Artificial Sequence
  Description of Artificial Sequence: Synthetic Antisense oligonucleotide
  misc_feature (1)..(2): bicyclic nucleic acid (BNA)
cggtaagtt

SEQ ID NO: 7362 - DNA, 8 bp, Artificial Sequence
  Description of Artificial Sequence: Synthetic Antisense oligonucleotide
  misc_feature (1)..(2): bicyclic nucleic acid (BNA)
cggtaagt

SEQ ID NO: 7363 - DNA, 20 bp, Artificial Sequence
  Description of Artificial Sequence: Synthetic Antisense oligonucleotide
  misc_feature (1)..(2): bicyclic nucleic acid (BNA)
tcggtaagttctgtccaagc

SEQ ID NO: 7364 - DNA, 19 bp, Artificial Sequence
  Description of Artificial Sequence: Synthetic Antisense oligonucleotide
  misc_feature (1)..(2): bicyclic nucleic acid (BNA)
tcggtaagttctgtccaag

SEQ ID NO: 7365 - DNA, 18 bp, Artificial Sequence
  Description of Artificial Sequence: Synthetic Antisense oligonucleotide
  misc_feature (1)..(2): bicyclic nucleic acid (BNA)
tcggtaagttctgtccaa

SEQ ID NO: 7366 - DNA, 17 bp, Artificial Sequence
  Description of Artificial Sequence: Synthetic Antisense oligonucleotide
  misc_feature (1)..(2): bicyclic nucleic acid (BNA)
tcggtaagttctgtcca

SEQ ID NO: 7367 - DNA, 16 bp, Artificial Sequence
  Description of Artificial Sequence: Synthetic Antisense oligonucleotide
  misc_feature (1)..(2): bicyclic nucleic acid (BNA)
tcggtaagttctgtcc

SEQ ID NO: 7368 - DNA, 15 bp, Artificial Sequence
  Description of Artificial Sequence: Synthetic Antisense oligonucleotide
  misc_feature (1)..(2): bicyclic nucleic acid (BNA)
tcggtaagttctgtc

SEQ ID NO: 7369 - DNA, 14 bp, Artificial Sequence
  Description of Artificial Sequence: Synthetic Antisense oligonucleotide
  misc_feature (1)..(2): bicyclic nucleic acid (BNA)
tcggtaagttctgt

SEQ ID NO: 7370 - DNA, 13 bp, Artificial Sequence
  Description of Artificial Sequence: Synthetic Antisense oligonucleotide
  misc_feature (1)..(2): bicyclic nucleic acid (BNA)
tcggtaagttctg

SEQ ID NO: 7371 - DNA, 12 bp, Artificial Sequence
  Description of Artificial Sequence: Synthetic Antisense oligonucleotide
  misc_feature (1)..(2): bicyclic nucleic acid (BNA)
tcggtaagttct

SEQ ID NO: 7372 - DNA, 11 bp, Artificial Sequence
  Description of Artificial Sequence: Synthetic Antisense oligonucleotide
  misc_feature (1)..(2): bicyclic nucleic acid (BNA)
tcggtaagttc

SEQ ID NO: 7373 - DNA, 10 bp, Artificial Sequence
  Description of Artificial Sequence: Synthetic Antisense oligonucleotide
  misc_feature (1)..(2): bicyclic nucleic acid (BNA)
tcggtaagtt

SEQ ID NO: 7374 - DNA, 9 bp, Artificial Sequence
  Description of Artificial Sequence: Synthetic Antisense oligonucleotide
  misc_feature (1)..(2): bicyclic nucleic acid (BNA)
tcggtaagt

SEQ ID NO: 7375 - DNA, 20 bp, Artificial Sequence
  Description of Artificial Sequence: Synthetic Antisense oligonucleotide
  misc_feature (1)..(2): bicyclic nucleic acid (BNA)
gtcggtaagttctgtccaag

SEQ ID NO: 7376 - DNA, 19 bp, Artificial Sequence
  Description of Artificial Sequence: Synthetic Antisense oligonucleotide
  misc_feature (1)..(2): bicyclic nucleic acid (BNA)
gtcggtaagttctgtccaa

SEQ ID NO: 7377 - DNA, 18 bp, Artificial Sequence
  Description of Artificial Sequence: Synthetic Antisense oligonucleotide
  misc_feature (1)..(2): bicyclic nucleic acid (BNA)
gtcggtaagttctgtcca

SEQ ID NO: 7378 - DNA, 17 bp, Artificial Sequence
  Description of Artificial Sequence: Synthetic Antisense oligonucleotide
  misc_feature (1)..(2): bicyclic nucleic acid (BNA)
gtcggtaagttctgtcc

SEQ ID NO: 7379 - DNA, 16 bp, Artificial Sequence
  Description of Artificial Sequence: Synthetic Antisense oligonucleotide
  misc_feature (1)..(2): bicyclic nucleic acid (BNA)
gtcggtaagttctgtc

SEQ ID NO: 7380 - DNA, 15 bp, Artificial Sequence
  Description of Artificial Sequence: Synthetic Antisense oligonucleotide
  misc_feature (1)..(2): bicyclic nucleic acid (BNA)
gtcggtaagttctgt

SEQ ID NO: 7381 - DNA, 14 bp, Artificial Sequence
  Description of Artificial Sequence: Synthetic Antisense oligonucleotide
  misc_feature (1)..(2): bicyclic nucleic acid (BNA)
gtcggtaagttctg

SEQ ID NO: 7382 - DNA, 13 bp, Artificial Sequence
  Description of Artificial Sequence: Synthetic Antisense oligonucleotide
  misc_feature (1)..(2): bicyclic nucleic acid (BNA)
gtcggtaagttct

SEQ ID NO: 7383 - DNA, 12 bp, Artificial Sequence
  Description of Artificial Sequence: Synthetic Antisense oligonucleotide
  misc_feature (1)..(2): bicyclic nucleic acid (BNA)
gtcggtaagttc

SEQ ID NO: 7384 - DNA, 11 bp, Artificial Sequence
  Description of Artificial Sequence: Synthetic Antisense oligonucleotide
  misc_feature (1)..(2): bicyclic nucleic acid (BNA)
gtcggtaagtt

SEQ ID NO: 7385 - DNA, 10 bp, Artificial Sequence
  Description of Artificial Sequence: Synthetic Antisense oligonucleotide
  misc_feature (1)..(2): bicyclic nucleic acid (BNA)
gtcggtaagt

SEQ ID NO: 7386 - DNA, 20 bp, Artificial Sequence
  Description of Artificial Sequence: Synthetic Antisense oligonucleotide
  misc_feature (1)..(2): bicyclic nucleic acid (BNA)
agtcggtaagttctgtccaa

SEQ ID NO: 7387 - DNA, 19 bp, Artificial Sequence
  Description of Artificial Sequence: Synthetic Antisense oligonucleotide
  misc_feature (1)..(2): bicyclic nucleic acid (BNA)
agtcggtaagttctgtcca

SEQ ID NO: 7388 - DNA, 17 bp, Artificial Sequence
  Description of Artificial Sequence: Synthetic Antisense oligonucleotide
  misc_feature (1)..(2): bicyclic nucleic acid (BNA)
agtcggtaagttctgtc

SEQ ID NO: 7389 - DNA, 16 bp, Artificial Sequence
  Description of Artificial Sequence: Synthetic Antisense oligonucleotide
  misc_feature (1)..(2): bicyclic nucleic acid (BNA)
agtcggtaagttctgt

SEQ ID NO: 7390 - DNA, 15 bp, Artificial Sequence
  Description of Artificial Sequence: Synthetic Antisense oligonucleotide
  misc_feature (1)..(2): bicyclic nucleic acid (BNA)
agtcggtaagttctg

SEQ ID NO: 7391 - DNA, 14 bp, Artificial Sequence
  Description of Artificial Sequence: Synthetic Antisense oligonucleotide
  misc_feature (1)..(2): bicyclic nucleic acid (BNA)
agtcggtaagttct

SEQ ID NO: 7392 - DNA, 13 bp, Artificial Sequence
  Description of Artificial Sequence: Synthetic Antisense oligonucleotide
  misc_feature (1)..(2): bicyclic nucleic acid (BNA)
agtcggtaagttc

SEQ ID NO: 7393 - DNA, 12 bp, Artificial Sequence
  Description of Artificial Sequence: Synthetic Antisense oligonucleotide
  misc_feature (1)..(2): bicyclic nucleic acid (BNA)
agtcggtaagtt

SEQ ID NO: 7394 - DNA, 11 bp, Artificial Sequence
  Description of Artificial Sequence: Synthetic Antisense oligonucleotide
  misc_feature (1)..(2): bicyclic nucleic acid (BNA)
agtcggtaagt

SEQ ID NO: 7395 - DNA, 20 bp, Artificial Sequence
  Description of Artificial Sequence: Synthetic Antisense oligonucleotide
  misc_feature (1)..(2): bicyclic nucleic acid (BNA)
cagtcggtaagttctgtcca

SEQ ID NO: 7396 - DNA, 19 bp, Artificial Sequence
  Description of Artificial Sequence: Synthetic Antisense oligonucleotide
  misc_feature (1)..(2): bicyclic nucleic acid (BNA)
cagtcggtaagttctgtcc

SEQ ID NO: 7397 - DNA, 18 bp, Artificial Sequence
  Description of Artificial Sequence: Synthetic Antisense oligonucleotide
  misc_feature (1)..(2): bicyclic nucleic acid (BNA)
cagtcggtaagttctgtc

SEQ ID NO: 7398 - DNA, 17 bp, Artificial Sequence
  Description of Artificial Sequence: Synthetic Antisense oligonucleotide
  misc_feature (1)..(2): bicyclic nucleic acid (BNA)
cagtcggtaagttctgt

SEQ ID NO: 7399 - DNA, 16 bp, Artificial Sequence
  Description of Artificial Sequence: Synthetic Antisense oligonucleotide
  misc_feature (1)..(2): bicyclic nucleic acid (BNA)
cagtcggtaagttctg

SEQ ID NO: 7400 - DNA, 15 bp, Artificial Sequence
  Description of Artificial Sequence: Synthetic Antisense oligonucleotide
  misc_feature (1)..(2): bicyclic nucleic acid (BNA)
cagtcggtaagttct

SEQ ID NO: 7401 - DNA, 14 bp, Artificial Sequence
  Description of Artificial Sequence: Synthetic Antisense oligonucleotide
  misc_feature (1)..(2): bicyclic nucleic acid (BNA)
cagtcggtaagttc

SEQ ID NO: 7402 - DNA, 13 bp, Artificial Sequence
  Description of Artificial Sequence: Synthetic Antisense oligonucleotide
  misc_feature (1)..(2): bicyclic nucleic acid (BNA)
cagtcggtaagtt

SEQ ID NO: 7403 - DNA, 12 bp, Artificial Sequence
  Description of Artificial Sequence: Synthetic Antisense oligonucleotide
  misc_feature (1)..(2): bicyclic nucleic acid (BNA)
cagtcggtaagt

SEQ ID NO: 7404 - DNA, 20 bp, Artificial Sequence
  Description of Artificial Sequence: Synthetic Antisense oligonucleotide
  misc_feature (1)..(2): bicyclic nucleic acid (BNA)
ccagtcggtaagttctgtcc

SEQ ID NO: 7405 - DNA, 19 bp, Artificial Sequence
  Description of Artificial Sequence: Synthetic Antisense oligonucleotide
  misc_feature (1)..(2): bicyclic nucleic acid (BNA)
ccagtcggtaagttctgtc

SEQ ID NO: 7406 - DNA, 18 bp, Artificial Sequence
  Description of Artificial Sequence: Synthetic Antisense oligonucleotide
  misc_feature (1)..(2): bicyclic nucleic acid (BNA)
ccagtcggtaagttctgt

SEQ ID NO: 7407 - DNA, 17 bp, Artificial Sequence
  Description of Artificial Sequence: Synthetic Antisense oligonucleotide
  misc_feature (1)..(2): bicyclic nucleic acid (BNA)
ccagtcggtaagttctg

SEQ ID NO: 7408 - DNA, 16 bp, Artificial Sequence
  Description of Artificial Sequence: Synthetic Antisense oligonucleotide
  misc_feature (1)..(2): bicyclic nucleic acid (BNA)
ccagtcggtaagttct

SEQ ID NO: 7409 - DNA, 15 bp, Artificial Sequence
  Description of Artificial Sequence: Synthetic Antisense oligonucleotide
  misc_feature (1)..(2): bicyclic nucleic acid (BNA)
ccagtcggtaagttc

SEQ ID NO: 7410 - DNA, 14 bp, Artificial Sequence
  Description of Artificial Sequence: Synthetic Antisense oligonucleotide
  misc_feature (1)..(2): bicyclic nucleic acid (BNA)
ccagtcggtaagtt

SEQ ID NO: 7411 - DNA, 13 bp, Artificial Sequence
  Description of Artificial Sequence: Synthetic Antisense oligonucleotide
  misc_feature (1)..(2): bicyclic nucleic acid (BNA)
ccagtcggtaagt

SEQ ID NO: 7412 - DNA, 20 bp, Artificial Sequence
  Description of Artificial Sequence: Synthetic Antisense oligonucleotide
  misc_feature (1)..(2): bicyclic nucleic acid (BNA)
gccagtcggtaagttctgtc

SEQ ID NO: 7413 - DNA, 19 bp, Artificial Sequence
  Description of Artificial Sequence: Synthetic Antisense oligonucleotide
  misc_feature (1)..(2): bicyclic nucleic acid (BNA)
gccagtcggtaagttctgt

SEQ ID NO: 7414 - DNA, 18 bp, Artificial Sequence
  Description of Artificial Sequence: Synthetic Antisense oligonucleotide
  misc_feature (1)..(2): bicyclic nucleic acid (BNA)
gccagtcggtaagttctg

SEQ ID NO: 7415 - DNA, 17 bp, Artificial Sequence
  Description of Artificial Sequence: Synthetic Antisense oligonucleotide
  misc_feature (1)..(2): bicyclic nucleic acid (BNA)
gccagtcggtaagttct

SEQ ID NO: 7416 - DNA, 16 bp, Artificial Sequence
  Description of Artificial Sequence: Synthetic Antisense oligonucleotide
  misc_feature (1)..(2): bicyclic nucleic acid (BNA)
gccagtcggtaagttc

SEQ ID NO: 7417 - DNA, 15 bp, Artificial Sequence
  Description of Artificial Sequence: Synthetic Antisense oligonucleotide
  misc_feature (1)..(2): bicyclic nucleic acid (BNA)
gccagtcggtaagtt

SEQ ID NO: 7418 - DNA, 14 bp, Artificial Sequence
  Description of Artificial Sequence: Synthetic Antisense oligonucleotide
  misc_feature (1)..(2): bicyclic nucleic acid (BNA)
gccagtcggtaagt

SEQ ID NO: 7419 - DNA, 20 bp, Artificial Sequence
  Description of Artificial Sequence: Synthetic Antisense oligonucleotide
  misc_feature (1)..(2): bicyclic nucleic acid (BNA)
tcaaggaagatggcatttct

SEQ ID NO: 7420 - DNA, 22 bp, Artificial Sequence
  Description of Artificial Sequence: Synthetic Antisense oligonucleotide
  misc_feature (1)..(2): bicyclic nucleic acid (BNA)
tcaaggaagatggcatttctag

SEQ ID NO: 7421 - DNA, 16 bp, Artificial Sequence
  Description of Artificial Sequence: Synthetic Antisense oligonucleotide
  misc_feature (1)..(2): bicyclic nucleic acid (BNA)
tcaaggaagatggcat

SEQ ID NO: 7422 - DNA, 15 bp, Artificial Sequence
  Description of Artificial Sequence: Synthetic Antisense oligonucleotide
  misc_feature (1)..(2): bicyclic nucleic acid (BNA)
gaagatggcatttct

SEQ ID NO: 7423 - DNA, 21 bp, Artificial Sequence
  Description of Artificial Sequence: Synthetic Antisense oligonucleotide
  misc_feature (1)..(2): bicyclic nucleic acid (BNA)
tcaaggaagatggcatttcta

SEQ ID NO: 7424 - DNA, 19 bp, Artificial Sequence
  Description of Artificial Sequence: Synthetic Antisense oligonucleotide
  misc_feature (1)..(2): bicyclic nucleic acid (BNA)
tcaaggaagatggcatttc

SEQ ID NO: 7425 - DNA, 18 bp, Artificial Sequence
  Description of Artificial Sequence: Synthetic Antisense oligonucleotide
  misc_feature (1)..(2): bicyclic nucleic acid (BNA)
tcaaggaagatggcattt

SEQ ID NO: 7426 - DNA, 17 bp, Artificial Sequence
  Description of Artificial Sequence: Synthetic Antisense oligonucleotide
  misc_feature (1)..(2): bicyclic nucleic acid (BNA)
tcaaggaagatggcatt

SEQ ID NO: 7427 - DNA, 15 bp, Artificial Sequence
  Description of Artificial Sequence: Synthetic Antisense oligonucleotide
  misc_feature (1)..(2): bicyclic nucleic acid (BNA)
tcaaggaagatggca

SEQ ID NO: 7428 - DNA, 14 bp, Artificial Sequence
  Description of Artificial Sequence: Synthetic Antisense oligonucleotide
  misc_feature (1)..(2): bicyclic nucleic acid (BNA)
tcaaggaagatggc

SEQ ID NO: 7429 - DNA, 13 bp, Artificial Sequence
  Description of Artificial Sequence: Synthetic Antisense oligonucleotide
  misc_feature (1)..(2): bicyclic nucleic acid (BNA)
tcaaggaagatgg

SEQ ID NO: 7430 - DNA, 12 bp, Artificial Sequence
  Description of Artificial Sequence: Synthetic Antisense oligonucleotide
  misc_feature (1)..(2): bicyclic nucleic acid (BNA)
tcaaggaagatg

SEQ ID NO: 7431 - DNA, 11 bp, Artificial Sequence
  Description of Artificial Sequence: Synthetic Antisense oligonucleotide
  misc_feature (1)..(2): bicyclic nucleic acid (BNA)
tcaaggaagat

SEQ ID NO: 7432 - DNA, 10 bp, Artificial Sequence
  Description of Artificial Sequence: Synthetic Antisense oligonucleotide
  misc_feature (1)..(2): bicyclic nucleic acid (BNA)
tcaaggaaga

SEQ ID NO: 7433 - DNA, 9 bp, Artificial Sequence
  Description of Artificial Sequence: Synthetic Antisense oligonucleotide
  misc_feature (1)..(2): bicyclic nucleic acid (BNA)
tcaaggaag

SEQ ID NO: 7434 - DNA, 21 bp, Artificial Sequence
  Description of Artificial Sequence: Synthetic Antisense oligonucleotide
  misc_feature (1)..(2): bicyclic nucleic acid (BNA)
caaggaagatggcatttctag

SEQ ID NO: 7435 - DNA, 20 bp, Artificial Sequence
  Description of Artificial Sequence: Synthetic Antisense oligonucleotide
  misc_feature (1)..(2): bicyclic nucleic acid (BNA)
caaggaagatggcatttcta

SEQ ID NO: 7436 - DNA, 19 bp, Artificial Sequence
  Description of Artificial Sequence: Synthetic Antisense oligonucleotide
  misc_feature (1)..(2): bicyclic nucleic acid (BNA)
caaggaagatggcatttct

SEQ ID NO: 7437 - DNA, 18 bp, Artificial Sequence
  Description of Artificial Sequence: Synthetic Antisense oligonucleotide
  misc_feature (1)..(2): bicyclic nucleic acid (BNA)
caaggaagatggcatttc

SEQ ID NO: 7438 - DNA, 17 bp, Artificial Sequence
  Description of Artificial Sequence: Synthetic Antisense oligonucleotide
  misc_feature (1)..(2): bicyclic nucleic acid (BNA)
caaggaagatggcattt

SEQ ID NO: 7439 - DNA, 16 bp, Artificial Sequence
  Description of Artificial Sequence: Synthetic Antisense oligonucleotide
  misc_feature (1)..(2): bicyclic nucleic acid (BNA)
caaggaagatggcatt

SEQ ID NO: 7440 - DNA, 15 bp, Artificial Sequence
  Description of Artificial Sequence: Synthetic Antisense oligonucleotide
  misc_feature (1)..(2): bicyclic nucleic acid (BNA)
caaggaagatggcat

SEQ ID NO: 7441 - DNA, 14 bp, Artificial Sequence
  Description of Artificial Sequence: Synthetic Antisense oligonucleotide
  misc_feature (1)..(2): bicyclic nucleic acid (BNA)
caaggaagatggca

SEQ ID NO: 7442 - DNA, 13 bp, Artificial Sequence
  Description of Artificial Sequence: Synthetic Antisense oligonucleotide
  misc_feature (1)..(2): bicyclic nucleic acid (BNA)
caaggaagatggc

SEQ ID NO: 7443 - DNA, 12 bp, Artificial Sequence
  Description of Artificial Sequence: Synthetic Antisense oligonucleotide
  misc_feature (1)..(2): bicyclic nucleic acid (BNA)
caaggaagatgg

SEQ ID NO: 7444 - DNA, 11 bp, Artificial Sequence
  Description of Artificial Sequence: Synthetic Antisense oligonucleotide
  misc_feature (1)..(2): bicyclic nucleic acid (BNA)
caaggaagatg

SEQ ID NO: 7445 - DNA, 10 bp, Artificial Sequence
  Description of Artificial Sequence: Synthetic Antisense oligonucleotide
  misc_feature (1)..(2): bicyclic nucleic acid (BNA)
caaggaagat

SEQ ID NO: 7446 - DNA, 20 bp, Artificial Sequence
  Description of Artificial Sequence: Synthetic Antisense oligonucleotide
  misc_feature (1)..(2): bicyclic nucleic acid (BNA)
aaggaagatggcatttctag

SEQ ID NO: 7447 - DNA, 19 bp, Artificial Sequence
  Description of Artificial Sequence: Synthetic Antisense oligonucleotide
  misc_feature (1)..(2): bicyclic nucleic acid (BNA)
aaggaagatggcatttcta

SEQ ID NO: 7448 - DNA, 18 bp, Artificial Sequence
  Description of Artificial Sequence: Synthetic Antisense oligonucleotide
  misc_feature (1)..(2): bicyclic nucleic acid (BNA)
aaggaagatggcatttct

SEQ ID NO: 7449 - DNA, 17 bp, Artificial Sequence
  Description of Artificial Sequence: Synthetic Antisense oligonucleotide
  misc_feature (1)..(2): bicyclic nucleic acid (BNA)
aaggaagatggcatttc

SEQ ID NO: 7450 - DNA, 16 bp, Artificial Sequence
  Description of Artificial Sequence: Synthetic Antisense oligonucleotide
  misc_feature (1)..(2): bicyclic nucleic acid (BNA)
aaggaagatggcattt

SEQ ID NO: 7451 - DNA, 15 bp, Artificial Sequence
  Description of Artificial Sequence: Synthetic Antisense oligonucleotide
  misc_feature (1)..(2): bicyclic nucleic acid (BNA)
aaggaagatggcatt

SEQ ID NO: 7452 - DNA, 14 bp, Artificial Sequence
  Description of Artificial Sequence: Synthetic Antisense oligonucleotide
  misc_feature (1)..(2): bicyclic nucleic acid (BNA)
aaggaagatggcat

SEQ ID NO: 7453 - DNA, 13 bp, Artificial Sequence
  Description of Artificial Sequence: Synthetic Antisense oligonucleotide
  misc_feature (1)..(2): bicyclic nucleic acid (BNA)
aaggaagatggca

SEQ ID NO: 7454 - DNA, 12 bp, Artificial Sequence
  Description of Artificial Sequence: Synthetic Antisense oligonucleotide
  misc_feature (1)..(2): bicyclic nucleic acid (BNA)
aaggaagatggc

SEQ ID NO: 7455 - DNA, 11 bp, Artificial Sequence
  Description of Artificial Sequence: Synthetic Antisense oligonucleotide
  misc_feature (1)..(2): bicyclic nucleic acid (BNA)
aaggaagatgg

SEQ ID NO: 7456 - DNA, 10 bp, Artificial Sequence
  Description of Artificial Sequence: Synthetic Antisense oligonucleotide
  misc_feature (1)..(2): bicyclic nucleic acid (BNA)
aaggaagatg

SEQ ID NO: 7457 - DNA, 9 bp, Artificial Sequence
  Description of Artificial Sequence: Synthetic Antisense oligonucleotide
  misc_feature (1)..(2): bicyclic nucleic acid (BNA)
aaggaagat

SEQ ID NO: 7458 - DNA, 19 bp, Artificial Sequence
  Description of Artificial Sequence: Synthetic Antisense oligonucleotide
  misc_feature (1)..(2): bicyclic nucleic acid (BNA)
aggaagatggcatttctag

SEQ ID NO: 7459 - DNA, 18 bp, Artificial Sequence
  Description of Artificial Sequence: Synthetic Antisense oligonucleotide
  misc_feature (1)..(2): bicyclic nucleic acid (BNA)
aggaagatggcatttcta

SEQ ID NO: 7460 - DNA, 17 bp, Artificial Sequence
  Description of Artificial Sequence: Synthetic Antisense oligonucleotide
  misc_feature (1)..(2): bicyclic nucleic acid (BNA)
aggaagatggcatttct

SEQ ID NO: 7461 - DNA, 16 bp, Artificial Sequence
  Description of Artificial Sequence: Synthetic Antisense oligonucleotide
  misc_feature (1)..(2): bicyclic nucleic acid (BNA)
aggaagatggcatttc

SEQ ID NO: 7462 - DNA, 15 bp, Artificial Sequence
  Description of Artificial Sequence: Synthetic Antisense oligonucleotide
  misc_feature (1)..(2): bicyclic nucleic acid (BNA)
aggaagatggcattt

SEQ ID NO: 7463 - DNA, 14 bp, Artificial Sequence
  Description of Artificial Sequence: Synthetic Antisense oligonucleotide
  misc_feature (1)..(2): bicyclic nucleic acid (BNA)
aggaagatggcatt

SEQ ID NO: 7464 - DNA, 13 bp, Artificial Sequence
  Description of Artificial Sequence: Synthetic Antisense oligonucleotide
  misc_feature (1)..(2): bicyclic nucleic acid (BNA)
aggaagatggcat

SEQ ID NO: 7465 - DNA, 12 bp, Artificial Sequence
  Description of Artificial Sequence: Synthetic Antisense oligonucleotide
  misc_feature (1)..(2): bicyclic nucleic acid (BNA)
aggaagatggca

SEQ ID NO: 7466 - DNA, 10 bp, Artificial Sequence
  Description of Artificial Sequence: Synthetic Antisense oligonucleotide
  misc_feature (1)..(2): bicyclic nucleic acid (BNA)
aggaagatgg

SEQ ID NO: 7467 - DNA, 9 bp, Artificial Sequence
  Description of Artificial Sequence: Synthetic Antisense oligonucleotide
  misc_feature (1)..(2): bicyclic nucleic acid (BNA)
aggaagatg

SEQ ID NO: 7468 - DNA, 8 bp, Artificial Sequence
  Description of Artificial Sequence: Synthetic Antisense oligonucleotide
  misc_feature (1)..(2): bicyclic nucleic acid (BNA)
aggaagat

SEQ ID NO: 7469 - DNA, 18 bp, Artificial Sequence
  Description of Artificial Sequence: Synthetic Antisense oligonucleotide
  misc_feature (1)..(2): bicyclic nucleic acid (BNA)
ggaagatggcatttctag

SEQ ID NO: 7470 - DNA, 17 bp, Artificial Sequence
  Description of Artificial Sequence: Synthetic Antisense oligonucleotide
  misc_feature (1)..(2): bicyclic nucleic acid (BNA)
ggaagatggcatttcta

SEQ ID NO: 7471 - DNA, 16 bp, Artificial Sequence
  Description of Artificial Sequence: Synthetic Antisense oligonucleotide
  misc_feature (1)..(2): bicyclic nucleic acid (BNA)
ggaagatggcatttct

SEQ ID NO: 7472 - DNA, 15 bp, Artificial Sequence
  Description of Artificial Sequence: Synthetic Antisense oligonucleotide
  misc_feature (1)..(2): bicyclic nucleic acid (BNA)
ggaagatggcatttc

SEQ ID NO: 7473 - DNA, 14 bp, Artificial Sequence
  Description of Artificial Sequence: Synthetic Antisense oligonucleotide
  misc_feature (1)..(2): bicyclic nucleic acid (BNA)
ggaagatggcattt

SEQ ID NO: 7474 - DNA, 13 bp, Artificial Sequence
  Description of Artificial Sequence: Synthetic Antisense oligonucleotide
  misc_feature (1)..(2): bicyclic nucleic acid (BNA)
ggaagatggcatt

SEQ ID NO: 7475 - DNA, 12 bp, Artificial Sequence
  Description of Artificial Sequence: Synthetic Antisense oligonucleotide
  misc_feature (1)..(2): bicyclic nucleic acid (BNA)
ggaagatggcat

SEQ ID NO: 7476 - DNA, 11 bp, Artificial Sequence
  Description of Artificial Sequence: Synthetic Antisense oligonucleotide
  misc_feature (1)..(2): bicyclic nucleic acid (BNA)
ggaagatggca

SEQ ID NO: 7477 - DNA, 10 bp, Artificial Sequence
  Description of Artificial Sequence: Synthetic Antisense oligonucleotide
  misc_feature (1)..(2): bicyclic nucleic acid (BNA)
ggaagatggc

SEQ ID NO: 7478 - DNA, 8 bp, Artificial Sequence
  Description of Artificial Sequence: Synthetic Antisense oligonucleotide
  misc_feature (1)..(2): bicyclic nucleic acid (BNA)
ggaagatg

SEQ ID NO: 7479 - DNA, 17 bp, Artificial Sequence
  Description of Artificial Sequence: Synthetic Antisense oligonucleotide
  misc_feature (1)..(2): bicyclic nucleic acid (BNA)
gaagatggcatttctag

SEQ ID NO: 7480 - DNA, 16 bp, Artificial Sequence
  Description of Artificial Sequence: Synthetic Antisense oligonucleotide
  misc_feature (1)..(2): bicyclic nucleic acid (BNA)
gaagatggcatttcta

SEQ ID NO: 7481 - DNA, 14 bp, Artificial Sequence
  Description of Artificial Sequence: Synthetic Antisense oligonucleotide
  misc_feature (1)..(2): bicyclic nucleic acid (BNA)
gaagatggcatttc

SEQ ID NO: 7482 - DNA, 13 bp, Artificial Sequence
  Description of Artificial Sequence: Synthetic Antisense oligonucleotide
  misc_feature (1)..(2): bicyclic nucleic acid (BNA)
gaagatggcattt

SEQ ID NO: 7483 - DNA, 12 bp, Artificial Sequence
  Description of Artificial Sequence: Synthetic Antisense oligonucleotide
  misc_feature (1)..(2): bicyclic nucleic acid (BNA)
gaagatggcatt

SEQ ID NO: 7484 - DNA, 11 bp, Artificial Sequence
  Description of Artificial Sequence: Synthetic Antisense oligonucleotide
  misc_feature (1)..(2): bicyclic nucleic acid (BNA)
gaagatggcat

SEQ ID NO: 7485 - DNA, 10 bp, Artificial Sequence
  Description of Artificial Sequence: Synthetic Antisense oligonucleotide
  misc_feature (1)..(2): bicyclic nucleic acid (BNA)
gaagatggca

SEQ ID NO: 7486 - DNA, 9 bp, Artificial Sequence
  Description of Artificial Sequence: Synthetic Antisense oligonucleotide
  misc_feature (1)..(2): bicyclic nucleic acid (BNA)
gaagatggc

SEQ ID NO: 7487 - DNA, 8 bp, Artificial Sequence
  Description of Artificial Sequence: Synthetic Antisense oligonucleotide
  misc_feature (1)..(2): bicyclic nucleic acid (BNA)
gaagatgg

SEQ ID NO: 7488 - DNA, 16 bp, Artificial Sequence
  Description of Artificial Sequence: Synthetic Antisense oligonucleotide
  misc_feature (1)..(2): bicyclic nucleic acid (BNA)
aagatggcatttctag

SEQ ID NO: 7489 - DNA, 15 bp, Artificial Sequence
  Description of Artificial Sequence: Synthetic Antisense oligonucleotide
  misc_feature (1)..(2): bicyclic nucleic acid (BNA)
aagatggcatttcta

SEQ ID NO: 7490 - DNA, 14 bp, Artificial Sequence
  Description of Artificial Sequence: Synthetic Antisense oligonucleotide
  misc_feature (1)..(2): bicyclic nucleic acid (BNA)
aagatggcatttct

SEQ ID NO: 7491 - DNA, 13 bp, Artificial Sequence
  Description of Artificial Sequence: Synthetic Antisense oligonucleotide
  misc_feature (1)..(2): bicyclic nucleic acid (BNA)
aagatggcatttc

SEQ ID NO: 7492 - DNA, 12 bp, Artificial Sequence
  Description of Artificial Sequence: Synthetic Antisense oligonucleotide
  misc_feature (1)..(2): bicyclic nucleic acid (BNA)
aagatggcattt

SEQ ID NO: 7493 - DNA, 11 bp, Artificial Sequence
  Description of Artificial Sequence: Synthetic Antisense oligonucleotide
  misc_feature (1)..(2): bicyclic nucleic acid (BNA)
aagatggcatt

SEQ ID NO: 7494 - DNA, 10 bp, Artificial Sequence
  Description of Artificial Sequence: Synthetic Antisense oligonucleotide
  misc_feature (1)..(2): bicyclic nucleic acid (BNA)
aagatggcat

SEQ ID NO: 7495 - DNA, 9 bp, Artificial Sequence
  Description of Artificial Sequence: Synthetic Antisense oligonucleotide
  misc_feature (1)..(2): bicyclic nucleic acid (BNA)
aagatggca

SEQ ID NO: 7496 - DNA, 8 bp, Artificial Sequence
  Description of Artificial Sequence: Synthetic Antisense oligonucleotide
  misc_feature (1)..(2): bicyclic nucleic acid (BNA)
aagatggc

SEQ ID NO: 7497 - DNA, 15 bp, Artificial Sequence
  Description of Artificial Sequence: Synthetic Antisense oligonucleotide
  misc_feature (1)..(2): bicyclic nucleic acid (BNA)
agatggcatttctag

SEQ ID NO: 7498 - DNA, 14 bp, Artificial Sequence
  Description of Artificial Sequence: Synthetic Antisense oligonucleotide
  misc_feature (1)..(2): bicyclic nucleic acid (BNA)
agatggcatttcta

SEQ ID NO: 7499 - DNA, 13 bp, Artificial Sequence
  Description of Artificial Sequence: Synthetic Antisense oligonucleotide
  misc_feature (1)..(2): bicyclic nucleic acid (BNA)
agatggcatttct

SEQ ID NO: 7500 - DNA, 12 bp, Artificial Sequence
  Description of Artificial Sequence: Synthetic Antisense oligonucleotide
  misc_feature (1)..(2): bicyclic nucleic acid (BNA)
agatggcatttc

SEQ ID NO: 7501 - DNA, 11 bp, Artificial Sequence
  Description of Artificial Sequence: Synthetic Antisense oligonucleotide
  misc_feature (1)..(2): bicyclic nucleic acid (BNA)
agatggcattt

SEQ ID NO: 7502 - DNA, 10 bp, Artificial Sequence
  Description of Artificial Sequence: Synthetic Antisense oligonucleotide
  misc_feature (1)..(2): bicyclic nucleic acid (BNA)
agatggcatt

SEQ ID NO: 7503 - DNA, 9 bp, Artificial Sequence
  Description of Artificial Sequence: Synthetic Antisense oligonucleotide
  misc_feature (1)..(2): bicyclic nucleic acid (BNA)
agatggcat

SEQ ID NO: 7504 - DNA, 8 bp, Artificial Sequence
  Description of Artificial Sequence: Synthetic Antisense oligonucleotide
  misc_feature (1)..(2): bicyclic nucleic acid (BNA)
agatggca

SEQ ID NO: 7505 - DNA, 30 bp, Artificial Sequence; identical to SEQ ID NO: 8
  Description of Artificial Sequence: Synthetic Antisense oligonucleotide
  misc_feature (1)..(2): bicyclic nucleic acid (BNA)

SEQ ID NO: 7506 - DNA, 29 bp, Artificial Sequence
  Description of Artificial Sequence: Synthetic Antisense oligonucleotide
  misc_feature (1)..(2): bicyclic nucleic acid (BNA)
ctccaacatcaaggaagatggcatttcta

SEQ ID NO: 7507 - DNA, 28 bp, Artificial Sequence
  Description of Artificial Sequence: Synthetic Antisense oligonucleotide
  misc_feature (1)..(2): bicyclic nucleic acid (BNA)
ctccaacatcaaggaagatggcatttct

SEQ ID NO: 7508 - DNA, 27 bp, Artificial Sequence
  Description of Artificial Sequence: Synthetic Antisense oligonucleotide
  misc_feature (1)..(2): bicyclic nucleic acid (BNA)
ctccaacatcaaggaagatggcatttc

SEQ ID NO: 7509 - DNA, 26 bp, Artificial Sequence
  Description of Artificial Sequence: Synthetic Antisense oligonucleotide
  misc_feature (1)..(2): bicyclic nucleic acid (BNA)
ctccaacatcaaggaagatggcattt

SEQ ID NO: 7510 - DNA, 25 bp, Artificial Sequence
  Description of Artificial Sequence: Synthetic Antisense oligonucleotide
  misc_feature (1)..(2): bicyclic nucleic acid (BNA)
ctccaacatcaaggaagatggcatt

SEQ ID NO: 7511 - DNA, 24 bp, Artificial Sequence
  Description of Artificial Sequence: Synthetic Antisense oligonucleotide
  misc_feature (1)..(2): bicyclic nucleic acid (BNA)
ctccaacatcaaggaagatggcat

SEQ ID NO: 7512 - DNA, 23 bp, Artificial Sequence
  Description of Artificial Sequence: Synthetic Antisense oligonucleotide
  misc_feature (1)..(2): bicyclic nucleic acid (BNA)
ctccaacatcaaggaagatggca

SEQ ID NO: 7513 - DNA, 22 bp, Artificial Sequence
  Description of Artificial Sequence: Synthetic Antisense oligonucleotide
  misc_feature (1)..(2): bicyclic nucleic acid (BNA)
ctccaacatcaaggaagatggc

SEQ ID NO: 7514 - DNA, 21 bp, Artificial Sequence
  Description of Artificial Sequence: Synthetic Antisense oligonucleotide
  misc_feature (1)..(2): bicyclic nucleic acid (BNA)
ctccaacatcaaggaagatgg

SEQ ID NO: 7515 - DNA, 20 bp, Artificial Sequence
  Description of Artificial Sequence: Synthetic Antisense oligonucleotide
  misc_feature (1)..(2): bicyclic nucleic acid (BNA)
ctccaacatcaaggaagatg

SEQ ID NO: 7516 - DNA, 19 bp, Artificial Sequence
  Description of Artificial Sequence: Synthetic Antisense oligonucleotide
  misc_feature (1)..(2): bicyclic nucleic acid (BNA)
ctccaacatcaaggaagat

SEQ ID NO: 7517 - DNA, 18 bp, Artificial Sequence
  Description of Artificial Sequence: Synthetic Antisense oligonucleotide
  misc_feature (1)..(2): bicyclic nucleic acid (BNA)
ctccaacatcaaggaaga

SEQ ID NO: 7518 - DNA, 17 bp, Artificial Sequence
  Description of Artificial Sequence: Synthetic Antisense oligonucleotide
  misc_feature (1)..(2): bicyclic nucleic acid (BNA)
ctccaacatcaaggaag

SEQ ID NO: 7519 - DNA, 29 bp, Artificial Sequence
  Description of Artificial Sequence: Synthetic Antisense oligonucleotide
  misc_feature (1)..(2): bicyclic nucleic acid (BNA)
tccaacatcaaggaagatggcatttctag

SEQ ID NO: 7520 - DNA, 28 bp, Artificial Sequence
  Description of Artificial Sequence: Synthetic Antisense oligonucleotide
  misc_feature (1)..(2): bicyclic nucleic acid (BNA)
tccaacatcaaggaagatggcatttcta

SEQ ID NO: 7521 - DNA, 27 bp, Artificial Sequence
  Description of Artificial Sequence: Synthetic Antisense oligonucleotide
  misc_feature (1)..(2): bicyclic nucleic acid (BNA)
tccaacatcaaggaagatggcatttct

SEQ ID NO: 7522 - DNA, 26 bp, Artificial Sequence
  Description of Artificial Sequence: Synthetic Antisense oligonucleotide
  misc_feature (1)..(2): bicyclic nucleic acid (BNA)
tccaacatcaaggaagatggcatttc

SEQ ID NO: 7523 - DNA, 25 bp, Artificial Sequence
  Description of Artificial Sequence: Synthetic Antisense oligonucleotide
  misc_feature (1)..(2): bicyclic nucleic acid (BNA)
tccaacatcaaggaagatggcattt

SEQ ID NO: 7524 - DNA, 24 bp, Artificial Sequence
  Description of Artificial Sequence: Synthetic Antisense oligonucleotide
  misc_feature (1)..(2): bicyclic nucleic acid (BNA)
tccaacatcaaggaagatggcatt

SEQ ID NO: 7525 - DNA, 23 bp, Artificial Sequence
  Description of Artificial Sequence: Synthetic Antisense oligonucleotide
  misc_feature (1)..(2): bicyclic nucleic acid (BNA)
tccaacatcaaggaagatggcat

SEQ ID NO: 7526 - DNA, 22 bp, Artificial Sequence
  Description of Artificial Sequence: Synthetic Antisense oligonucleotide
  misc_feature (1)..(2): bicyclic nucleic acid (BNA)
tccaacatcaaggaagatggca

SEQ ID NO: 7527 - DNA, 21 bp, Artificial Sequence
  Description of Artificial Sequence: Synthetic Antisense oligonucleotide
  misc_feature (1)..(2): bicyclic nucleic acid (BNA)
tccaacatcaaggaagatggc

SEQ ID NO: 7528 - DNA, 20 bp, Artificial Sequence
  Description of Artificial Sequence: Synthetic Antisense oligonucleotide
  misc_feature (1)..(2): bicyclic nucleic acid (BNA)
tccaacatcaaggaagatgg

SEQ ID NO: 7529 - DNA, 19 bp, Artificial Sequence
  Description of Artificial Sequence: Synthetic Antisense oligonucleotide
  misc_feature (1)..(2): bicyclic nucleic acid (BNA)
tccaacatcaaggaagatg

SEQ ID NO: 7530 - DNA, 18 bp, Artificial Sequence
  Description of Artificial Sequence: Synthetic Antisense oligonucleotide
  misc_feature (1)..(2): bicyclic nucleic acid (BNA)
tccaacatcaaggaagat

SEQ ID NO: 7531 - DNA, 17 bp, Artificial Sequence
  Description of Artificial Sequence: Synthetic Antisense oligonucleotide
  misc_feature (1)..(2): bicyclic nucleic acid (BNA)
tccaacatcaaggaaga

SEQ ID NO: 7532 - DNA, 16 bp, Artificial Sequence
  Description of Artificial Sequence: Synthetic Antisense oligonucleotide
  misc_feature (1)..(2): bicyclic nucleic acid (BNA)
tccaacatcaaggaag

SEQ ID NO: 7533 - DNA, 28 bp, Artificial Sequence
  Description of Artificial Sequence: Synthetic Antisense oligonucleotide
  misc_feature (1)..(2): bicyclic nucleic acid (BNA)
ccaacatcaaggaagatggcatttctag

SEQ ID NO: 7534 - DNA, 27 bp, Artificial Sequence
  Description of Artificial Sequence: Synthetic Antisense oligonucleotide
  misc_feature (1)..(2): bicyclic nucleic acid (BNA)
ccaacatcaaggaagatggcatttcta

SEQ ID NO: 7535 - DNA, 26 bp, Artificial Sequence
  Description of Artificial Sequence: Synthetic Antisense oligonucleotide
  misc_feature (1)..(2): bicyclic nucleic acid (BNA)
ccaacatcaaggaagatggcatttct

SEQ ID NO: 7536 - DNA, 25 bp, Artificial Sequence
  Description of Artificial Sequence: Synthetic Antisense oligonucleotide
  misc_feature (1)..(2): bicyclic nucleic acid (BNA)
ccaacatcaaggaagatggcatttc

SEQ ID NO: 7537 - DNA, 24 bp, Artificial Sequence
  Description of Artificial Sequence: Synthetic Antisense oligonucleotide
  misc_feature (1)..(2): bicyclic nucleic acid (BNA)
ccaacatcaaggaagatggcattt

SEQ ID NO: 7538 - DNA, 23 bp, Artificial Sequence
  Description of Artificial Sequence: Synthetic Antisense oligonucleotide
  misc_feature (1)..(2): bicyclic nucleic acid (BNA)
ccaacatcaaggaagatggcatt

SEQ ID NO: 7539 - DNA, 22 bp, Artificial Sequence
  Description of Artificial Sequence: Synthetic Antisense oligonucleotide
  misc_feature (1)..(2): bicyclic nucleic acid (BNA)
ccaacatcaaggaagatggcat

SEQ ID NO: 7540 - DNA, 21 bp, Artificial Sequence
  Description of Artificial Sequence: Synthetic Antisense oligonucleotide
  misc_feature (1)..(2): bicyclic nucleic acid (BNA)
ccaacatcaaggaagatggca

SEQ ID NO: 7541 - DNA, 20 bp, Artificial Sequence
  Description of Artificial Sequence: Synthetic Antisense oligonucleotide
  misc_feature (1)..(2): bicyclic nucleic acid (BNA)
ccaacatcaaggaagatggc

SEQ ID NO: 7542 - DNA, 19 bp, Artificial Sequence
  Description of Artificial Sequence: Synthetic Antisense oligonucleotide
  misc_feature (1)..(2): bicyclic nucleic acid (BNA)
ccaacatcaaggaagatgg

SEQ ID NO: 7543 - DNA, 18 bp, Artificial Sequence
  Description of Artificial Sequence: Synthetic Antisense oligonucleotide
  misc_feature (1)..(2): bicyclic nucleic acid (BNA)
ccaacatcaaggaagatg

SEQ ID NO: 7544 - DNA, 17 bp, Artificial Sequence
  Description of Artificial Sequence: Synthetic Antisense oligonucleotide
  misc_feature (1)..(2): bicyclic nucleic acid (BNA)
ccaacatcaaggaagat

SEQ ID NO: 7545 - DNA, 16 bp, Artificial Sequence
  Description of Artificial Sequence: Synthetic Antisense oligonucleotide
  misc_feature (1)..(2): bicyclic nucleic acid (BNA)
ccaacatcaaggaaga

SEQ ID NO: 7546 - DNA, 15 bp, Artificial Sequence
  Description of Artificial Sequence: Synthetic Antisense oligonucleotide
  misc_feature (1)..(2): bicyclic nucleic acid (BNA)
ccaacatcaaggaag

SEQ ID NO: 7547 - DNA, 27 bp, Artificial Sequence
  Description of Artificial Sequence: Synthetic Antisense oligonucleotide
  misc_feature (1)..(2): bicyclic nucleic acid (BNA)
caacatcaaggaagatggcatttctag

SEQ ID NO: 7548 - DNA, 26 bp, Artificial Sequence
  Description of Artificial Sequence: Synthetic Antisense oligonucleotide
  misc_feature (1)..(2): bicyclic nucleic acid (BNA)
caacatcaaggaagatggcatttcta

SEQ ID NO: 7549 - DNA, 25 bp, Artificial Sequence
  Description of Artificial Sequence: Synthetic Antisense oligonucleotide
  misc_feature (1)..(2): bicyclic nucleic acid (BNA)
caacatcaaggaagatggcatttct

SEQ ID NO: 7550 - DNA, 24 bp, Artificial Sequence
  Description of Artificial Sequence: Synthetic Antisense oligonucleotide
  misc_feature (1)..(2): bicyclic nucleic acid (BNA)
caacatcaaggaagatggcatttc

SEQ ID NO: 7551 - DNA, 23 bp, Artificial Sequence
  Description of Artificial Sequence: Synthetic Antisense oligonucleotide
  misc_feature (1)..(2): bicyclic nucleic acid (BNA)
caacatcaaggaagatggcattt

SEQ ID NO: 7552 - DNA, 22 bp, Artificial Sequence
  Description of Artificial Sequence: Synthetic Antisense oligonucleotide
  misc_feature (1)..(2): bicyclic nucleic acid (BNA)
caacatcaaggaagatggcatt

SEQ ID NO: 7553 - DNA, 21 bp, Artificial Sequence
  Description of Artificial Sequence: Synthetic Antisense oligonucleotide
  misc_feature (1)..(2): bicyclic nucleic acid (BNA)
caacatcaaggaagatggcat

SEQ ID NO: 7554 - DNA, 20 bp, Artificial Sequence
  Description of Artificial Sequence: Synthetic Antisense oligonucleotide
  misc_feature (1)..(2): bicyclic nucleic acid (BNA)
caacatcaaggaagatggca

SEQ ID NO: 7555 - DNA, 19 bp, Artificial Sequence
  Description of Artificial Sequence: Synthetic Antisense oligonucleotide
  misc_feature (1)..(2): bicyclic nucleic acid (BNA)
caacatcaaggaagatggc

SEQ ID NO: 7556 - DNA, 18 bp, Artificial Sequence
  Description of Artificial Sequence: Synthetic Antisense oligonucleotide
  misc_feature (1)..(2): bicyclic nucleic acid (BNA)
caacatcaaggaagatgg

SEQ ID NO: 7557 - DNA, 17 bp, Artificial Sequence
  Description of Artificial Sequence: Synthetic Antisense oligonucleotide
  misc_feature (1)..(2): bicyclic nucleic acid (BNA)
caacatcaaggaagatg

SEQ ID NO: 7558 - DNA, 16 bp, Artificial Sequence
  Description of Artificial Sequence: Synthetic Antisense oligonucleotide
  misc_feature (1)..(2): bicyclic nucleic acid (BNA)
caacatcaaggaagat

SEQ ID NO: 7559 - DNA, 15 bp, Artificial Sequence
  Description of Artificial Sequence: Synthetic Antisense oligonucleotide
  misc_feature (1)..(2): bicyclic nucleic acid (BNA)
caacatcaaggaaga

SEQ ID NO: 7560 - DNA, 14 bp, Artificial Sequence
  Description of Artificial Sequence: Synthetic Antisense oligonucleotide
  misc_feature (1)..(2): bicyclic nucleic acid (BNA)
caacatcaaggaag

SEQ ID NO: 7561 - DNA, 26 bp, Artificial Sequence
  Description of Artificial Sequence: Synthetic Antisense oligonucleotide
  misc_feature (1)..(2): bicyclic nucleic acid (BNA)
aacatcaaggaagatggcatttctag

SEQ ID NO: 7562 - DNA, 25 bp, Artificial Sequence
  Description of Artificial Sequence: Synthetic Antisense oligonucleotide
  misc_feature (1)..(2): bicyclic nucleic acid (BNA)
aacatcaaggaagatggcatttcta

SEQ ID NO: 7563 - DNA, 24 bp, Artificial Sequence
  Description of Artificial Sequence: Synthetic Antisense oligonucleotide
  misc_feature (1)..(2): bicyclic nucleic acid (BNA)
aacatcaaggaagatggcatttct

SEQ ID NO: 7564 - DNA, 23 bp, Artificial Sequence
  Description of Artificial Sequence: Synthetic Antisense oligonucleotide
  misc_feature (1)..(2): bicyclic nucleic acid (BNA)
aacatcaaggaagatggcatttc

SEQ ID NO: 7565 - DNA, 22 bp, Artificial Sequence
  Description of Artificial Sequence: Synthetic Antisense oligonucleotide
  misc_feature (1)..(2): bicyclic nucleic acid (BNA)
aacatcaaggaagatggcattt

SEQ ID NO: 7566 - DNA, 21 bp, Artificial Sequence
  Description of Artificial Sequence: Synthetic Antisense oligonucleotide
  misc_feature (1)..(2): bicyclic nucleic acid (BNA)
aacatcaaggaagatggcatt

SEQ ID NO: 7567 - DNA, 20 bp, Artificial Sequence
  Description of Artificial Sequence: Synthetic Antisense oligonucleotide
  misc_feature (1)..(2): bicyclic nucleic acid (BNA)
aacatcaaggaagatggcat

SEQ ID NO: 7568 - DNA, 19 bp, Artificial Sequence
  Description of Artificial Sequence: Synthetic Antisense oligonucleotide
  misc_feature (1)..(2): bicyclic nucleic acid (BNA)
aacatcaaggaagatggca

SEQ ID NO: 7569 - DNA, 18 bp, Artificial Sequence
  Description of Artificial Sequence: Synthetic Antisense oligonucleotide
  misc_feature (1)..(2): bicyclic nucleic acid (BNA)
aacatcaaggaagatggc

SEQ ID NO: 7570 - DNA, 17 bp, Artificial Sequence
  Description of Artificial Sequence: Synthetic Antisense oligonucleotide
  misc_feature (1)..(2): bicyclic nucleic acid (BNA)
aacatcaaggaagatgg

SEQ ID NO: 7571 - DNA, 16 bp, Artificial Sequence
  Description of Artificial Sequence: Synthetic Antisense oligonucleotide
  misc_feature (1)..(2): bicyclic nucleic acid (BNA)
aacatcaaggaagatg

SEQ ID NO: 7572 - DNA, 15 bp, Artificial Sequence
  Description of Artificial Sequence: Synthetic Antisense oligonucleotide
  misc_feature (1)..(2): bicyclic nucleic acid (BNA)
aacatcaaggaagat

SEQ ID NO: 7573 - DNA, 14 bp, Artificial Sequence
  Description of Artificial Sequence: Synthetic Antisense oligonucleotide
  misc_feature (1)..(2): bicyclic nucleic acid (BNA)
aacatcaaggaaga

SEQ ID NO: 7574 - DNA, 13 bp, Artificial Sequence
  Description of Artificial Sequence: Synthetic Antisense oligonucleotide
  misc_feature (1)..(2): bicyclic nucleic acid (BNA)
aacatcaaggaag

SEQ ID NO: 7575 - DNA, 25 bp, Artificial Sequence
  Description of Artificial Sequence: Synthetic Antisense oligonucleotide
  misc_feature (1)..(2): bicyclic nucleic acid (BNA)
acatcaaggaagatggcatttctag

SEQ ID NO: 7576 - DNA, 24 bp, Artificial Sequence
  Description of Artificial Sequence: Synthetic Antisense oligonucleotide
  misc_feature (1)..(2): bicyclic nucleic acid (BNA)
acatcaaggaagatggcatttcta

SEQ ID NO: 7577 - DNA, 23 bp, Artificial Sequence
  Description of Artificial Sequence: Synthetic Antisense oligonucleotide
  misc_feature (1)..(2): bicyclic nucleic acid (BNA)
acatcaaggaagatggcatttct

SEQ ID NO: 7578 - DNA, 22 bp, Artificial Sequence
  Description of Artificial Sequence: Synthetic Antisense oligonucleotide
  misc_feature (1)..(2): bicyclic nucleic acid (BNA)
acatcaaggaagatggcatttc

SEQ ID NO: 7579 - DNA, 21 bp, Artificial Sequence
  Description of Artificial Sequence: Synthetic Antisense oligonucleotide
  misc_feature (1)..(2): bicyclic nucleic acid (BNA)
acatcaaggaagatggcattt

SEQ ID NO: 7580 - DNA, 20 bp, Artificial Sequence
  Description of Artificial Sequence: Synthetic Antisense oligonucleotide
  misc_feature (1)..(2): bicyclic nucleic acid (BNA)
acatcaaggaagatggcatt

SEQ ID NO: 7581 - DNA, 19 bp, Artificial Sequence
  Description of Artificial Sequence: Synthetic Antisense oligonucleotide
  misc_feature (1)..(2): bicyclic nucleic acid (BNA)
acatcaaggaagatggcat

SEQ ID NO: 7582 - DNA, 18 bp, Artificial Sequence
  Description of Artificial Sequence: Synthetic Antisense oligonucleotide
  misc_feature (1)..(2): bicyclic nucleic acid (BNA)
acatcaaggaagatggca

SEQ ID NO: 7583 - DNA, 17 bp, Artificial Sequence
  Description of Artificial Sequence: Synthetic Antisense oligonucleotide
  misc_feature (1)..(2): bicyclic nucleic acid (BNA)
acatcaaggaagatggc

SEQ ID NO: 7584 - DNA, 16 bp, Artificial Sequence
  Description of Artificial Sequence: Synthetic Antisense oligonucleotide
  misc_feature (1)..(2): bicyclic nucleic acid (BNA)
acatcaaggaagatgg

SEQ ID NO: 7585 - DNA, 15 bp, Artificial Sequence
  Description of Artificial Sequence: Synthetic Antisense oligonucleotide
  misc_feature (1)..(2): bicyclic nucleic acid (BNA)
acatcaaggaagatg

SEQ ID NO: 7586 - DNA, 14 bp, Artificial Sequence
  Description of Artificial Sequence: Synthetic Antisense oligonucleotide
  misc_feature (1)..(2): bicyclic nucleic acid (BNA)
acatcaaggaagat

SEQ ID NO: 7587 - DNA, 13 bp, Artificial Sequence
  Description of Artificial Sequence: Synthetic Antisense oligonucleotide
  misc_feature (1)..(2): bicyclic nucleic acid (BNA)
acatcaaggaaga

SEQ ID NO: 7588 - DNA, 12 bp, Artificial Sequence
  Description of Artificial Sequence: Synthetic Antisense oligonucleotide
  misc_feature (1)..(2): bicyclic nucleic acid (BNA)
acatcaaggaag

SEQ ID NO: 7589 - DNA, 24 bp, Artificial Sequence
  Description of Artificial Sequence: Synthetic Antisense oligonucleotide
  misc_feature (1)..(2): bicyclic nucleic acid (BNA)
catcaaggaagatggcatttctag

SEQ ID NO: 7590 - DNA, 23 bp, Artificial Sequence
  Description of Artificial Sequence: Synthetic Antisense oligonucleotide
  misc_feature (1)..(2): bicyclic nucleic acid (BNA)
catcaaggaagatggcatttcta

SEQ ID NO: 7591 - DNA, 22 bp, Artificial Sequence
  Description of Artificial Sequence: Synthetic Antisense oligonucleotide
  misc_feature (1)..(2): bicyclic nucleic acid (BNA)
catcaaggaagatggcatttct

SEQ ID NO: 7592 - DNA, 21 bp, Artificial Sequence
  Description of Artificial Sequence: Synthetic Antisense oligonucleotide
  misc_feature (1)..(2): bicyclic nucleic acid (BNA)
catcaaggaagatggcatttc

SEQ ID NO: 7593 - DNA, 20 bp, Artificial Sequence
  Description of Artificial Sequence: Synthetic Antisense oligonucleotide
  misc_feature (1)..(2): bicyclic nucleic acid (BNA)
catcaaggaagatggcattt

SEQ ID NO: 7594 - DNA, 19 bp, Artificial Sequence
  Description of Artificial Sequence: Synthetic Antisense oligonucleotide
  misc_feature (1)..(2): bicyclic nucleic acid (BNA)
catcaaggaagatggcatt

SEQ ID NO: 7595 - DNA, 18 bp, Artificial Sequence
  Description of Artificial Sequence: Synthetic Antisense oligonucleotide
  misc_feature (1)..(2): bicyclic nucleic acid (BNA)
catcaaggaagatggcat

SEQ ID NO: 7596 - DNA, 17 bp, Artificial Sequence
  Description of Artificial Sequence: Synthetic Antisense oligonucleotide
  misc_feature (1)..(2): bicyclic nucleic acid (BNA)
catcaaggaagatggca

SEQ ID NO: 7597 - DNA, 16 bp, Artificial Sequence
  Description of Artificial Sequence: Synthetic Antisense oligonucleotide
  misc_feature (1)..(2): bicyclic nucleic acid (BNA)
catcaaggaagatggc

SEQ ID NO: 7598 - DNA, 15 bp, Artificial Sequence
  Description of Artificial Sequence: Synthetic Antisense oligonucleotide
  misc_feature (1)..(2): bicyclic nucleic acid (BNA)
catcaaggaagatgg

SEQ ID NO: 7599 - DNA, 14 bp, Artificial Sequence
  Description of Artificial Sequence: Synthetic Antisense oligonucleotide
  misc_feature (1)..(2): bicyclic nucleic acid (BNA)
catcaaggaagatg

SEQ ID NO: 7600 - DNA, 13 bp, Artificial Sequence
  Description of Artificial Sequence: Synthetic Antisense oligonucleotide
  misc_feature (1)..(2): bicyclic nucleic acid (BNA)
catcaaggaagat

SEQ ID NO: 7601 - DNA, 12 bp, Artificial Sequence
  Description of Artificial Sequence: Synthetic Antisense oligonucleotide
  misc_feature (1)..(2): bicyclic nucleic acid (BNA)
catcaaggaaga

SEQ ID NO: 7602 - DNA, 11 bp, Artificial Sequence
  Description of Artificial Sequence: Synthetic Antisense oligonucleotide
  misc_feature (1)..(2): bicyclic nucleic acid (BNA)
catcaaggaag

SEQ ID NO: 7603 - DNA, 23 bp, Artificial Sequence
  Description of Artificial Sequence: Synthetic Antisense oligonucleotide
  misc_feature (1)..(2): bicyclic nucleic acid (BNA)
atcaaggaagatggcatttctag

SEQ ID NO: 7604 - DNA, 22 bp, Artificial Sequence
  Description of Artificial Sequence: Synthetic Antisense oligonucleotide
  misc_feature (1)..(2): bicyclic nucleic acid (BNA)
atcaaggaagatggcatttcta

SEQ ID NO: 7605 - DNA, 21 bp, Artificial Sequence
  Description of Artificial Sequence: Synthetic Antisense oligonucleotide
  misc_feature (1)..(2): bicyclic nucleic acid (BNA)
atcaaggaagatggcatttct

SEQ ID NO: 7606 - DNA, 20 bp, Artificial Sequence
  Description of Artificial Sequence: Synthetic Antisense oligonucleotide
  misc_feature (1)..(2): bicyclic nucleic acid (BNA)
atcaaggaagatggcatttc

SEQ ID NO: 7607 - DNA, 19 bp, Artificial Sequence
  Description of Artificial Sequence: Synthetic Antisense oligonucleotide
  misc_feature (1)..(2): bicyclic nucleic acid (BNA)
atcaaggaagatggcattt

SEQ ID NO: 7608 - DNA, 18 bp, Artificial Sequence
  Description of Artificial Sequence: Synthetic Antisense oligonucleotide
  misc_feature (1)..(2): bicyclic nucleic acid (BNA)
atcaaggaagatggcatt

SEQ ID NO: 7609 - DNA, 17 bp, Artificial Sequence
  Description of Artificial Sequence: Synthetic Antisense oligonucleotide
  misc_feature (1)..(2): bicyclic nucleic acid (BNA)
atcaaggaagatggcat

SEQ ID NO: 7610 - DNA, 16 bp, Artificial Sequence
  Description of Artificial Sequence: Synthetic Antisense oligonucleotide
  misc_feature (1)..(2): bicyclic nucleic acid (BNA)
atcaaggaagatggca

SEQ ID NO: 7611 - DNA, 15 bp, Artificial Sequence
  Description of Artificial Sequence: Synthetic Antisense oligonucleotide
  misc_feature (1)..(2): bicyclic nucleic acid (BNA)
atcaaggaagatggc

SEQ ID NO: 7612 - DNA, 14 bp, Artificial Sequence
  Description of Artificial Sequence: Synthetic Antisense oligonucleotide
  misc_feature (1)..(2): bicyclic nucleic acid (BNA)
atcaaggaagatgg

SEQ ID NO: 7613 - DNA, 13 bp, Artificial Sequence
  Description of Artificial Sequence: Synthetic Antisense oligonucleotide
  misc_feature (1)..(2): bicyclic nucleic acid (BNA)
atcaaggaagatg

SEQ ID NO: 7614 - DNA, 12 bp, Artificial Sequence
  Description of Artificial Sequence: Synthetic Antisense oligonucleotide
  misc_feature (1)..(2): bicyclic nucleic acid (BNA)
atcaaggaagat

SEQ ID NO: 7615 - DNA, 11 bp, Artificial Sequence
  Description of Artificial Sequence: Synthetic Antisense oligonucleotide
  misc_feature (1)..(2): bicyclic nucleic acid (BNA)
atcaaggaaga

SEQ ID NO: 7616 - DNA, 10 bp, Artificial Sequence
  Description of Artificial Sequence: Synthetic Antisense oligonucleotide
  misc_feature (1)..(2): bicyclic nucleic acid (BNA)
atcaaggaag

SEQ ID NO: 7617 - DNA, 18 bp, Artificial Sequence
  Description of Artificial Sequence: Synthetic Antisense oligonucleotide
  misc_feature (17)..(18): bicyclic nucleic acid (BNA)
ggtaagttctgtccaagc

SEQ ID NO: 7618 - DNA, 18 bp, Artificial Sequence
  Description of Artificial Sequence: Synthetic Antisense oligonucleotide
  misc_feature (17)..(18): bicyclic nucleic acid (BNA)
gtaagttctgtccaagcc

SEQ ID NO: 7619 - DNA, 18 bp, Artificial Sequence
  Description of Artificial Sequence: Synthetic Antisense oligonucleotide
  misc_feature (17)..(18): bicyclic nucleic acid (BNA)
agtcggtaagttctgtcc

SEQ ID NO: 7620 - DNA, 18 bp, Artificial Sequence
  Description of Artificial Sequence: Synthetic Antisense oligonucleotide
  misc_feature (17)..(18): bicyclic nucleic acid (BNA)
ctgtccaagcccggttga

SEQ ID NO: 7621 - DNA, 15 bp, Artificial Sequence
  Description of Artificial Sequence: Synthetic Antisense oligonucleotide
  misc_feature (14)..(15): bicyclic nucleic acid (BNA)
taagttctgtccaag

SEQ ID NO: 7622 - DNA, 20 bp, Artificial Sequence
  Description of Artificial Sequence: Synthetic Antisense oligonucleotide
  misc_feature (19)..(20): bicyclic nucleic acid (BNA)
ttctgtccaagcccggttga

SEQ ID NO: 7623 - DNA, 19 bp, Artificial Sequence
  Description of Artificial Sequence: Synthetic Antisense oligonucleotide
  misc_feature (18)..(19): bicyclic nucleic acid (BNA)
ttctgtccaagcccggttg

SEQ ID NO: 7624 - DNA, 18 bp, Artificial Sequence
  Description of Artificial Sequence: Synthetic Antisense oligonucleotide
  misc_feature (17)..(18): bicyclic nucleic acid (BNA)
ttctgtccaagcccggtt

SEQ ID NO: 7625 - DNA, 17 bp, Artificial Sequence
  Description of Artificial Sequence: Synthetic Antisense oligonucleotide
  misc_feature (16)..(17): bicyclic nucleic acid (BNA)
ttctgtccaagcccggt

SEQ ID NO: 7626 - DNA, 16 bp, Artificial Sequence
  Description of Artificial Sequence: Synthetic Antisense oligonucleotide
  misc_feature (15)..(16): bicyclic nucleic acid (BNA)
ttctgtccaagcccgg

SEQ ID NO: 7627 - DNA, 15 bp, Artificial Sequence
  Description of Artificial Sequence: Synthetic Antisense oligonucleotide
  misc_feature (14)..(15): bicyclic nucleic acid (BNA)
ttctgtccaagcccg

SEQ ID NO: 7628 - DNA, 14 bp, Artificial Sequence
  Description of Artificial Sequence: Synthetic Antisense oligonucleotide
  misc_feature (13)..(14): bicyclic nucleic acid (BNA)
ttctgtccaagccc

SEQ ID NO: 7629 - DNA, 13 bp, Artificial Sequence
  Description of Artificial Sequence: Synthetic Antisense oligonucleotide
  misc_feature (12)..(13): bicyclic nucleic acid (BNA)
ttctgtccaagcc

SEQ ID NO: 7630 - DNA, 12 bp, Artificial Sequence
  Description of Artificial Sequence: Synthetic Antisense oligonucleotide
  misc_feature (11)..(12): bicyclic nucleic acid (BNA)
ttctgtccaagc

SEQ ID NO: 7631 - DNA, 11 bp, Artificial Sequence
  Description of Artificial Sequence: Synthetic Antisense oligonucleotide
  misc_feature (10)..(11): bicyclic nucleic acid (BNA)
ttctgtccaag

SEQ ID NO: 7632 - DNA, 10 bp, Artificial Sequence
  Description of Artificial Sequence: Synthetic Antisense oligonucleotide
  misc_feature (9)..(10): bicyclic nucleic acid (BNA)
ttctgtccaa

SEQ ID NO: 7633 - DNA, 9 bp, Artificial Sequence
  Description of Artificial Sequence: Synthetic Antisense oligonucleotide
  misc_feature (8)..(9): bicyclic nucleic acid (BNA)
ttctgtcca

SEQ ID NO: 7634 - DNA, 8 bp, Artificial Sequence
  Description of Artificial Sequence: Synthetic Antisense oligonucleotide
  misc_feature (7)..(8): bicyclic nucleic acid (BNA)
ttctgtcc

SEQ ID NO: 7635 - DNA, 19 bp, Artificial Sequence
  Description of Artificial Sequence: Synthetic Antisense oligonucleotide
  misc_feature (18)..(19): bicyclic nucleic acid (BNA)
tctgtccaagcccggttga

SEQ ID NO: 7636 - DNA, 18 bp, Artificial Sequence
  Description of Artificial Sequence: Synthetic Antisense oligonucleotide
  misc_feature (17)..(18): bicyclic nucleic acid (BNA)
tctgtccaagcccggttg

SEQ ID NO: 7637 - DNA, 17 bp, Artificial Sequence
  Description of Artificial Sequence: Synthetic Antisense oligonucleotide
  misc_feature (16)..(17): bicyclic nucleic acid (BNA)
tctgtccaagcccggtt

SEQ ID NO: 7638 - DNA, 16 bp, Artificial Sequence
  Description of Artificial Sequence: Synthetic Antisense oligonucleotide
  misc_feature (15)..(16): bicyclic nucleic acid (BNA)
tctgtccaagcccggt

SEQ ID NO: 7639 - DNA, 15 bp, Artificial Sequence
  Description of Artificial Sequence: Synthetic Antisense oligonucleotide
  misc_feature (14)..(15): bicyclic nucleic acid (BNA)
tctgtccaagcccgg

SEQ ID NO: 7640 - DNA, 14 bp, Artificial Sequence
  Description of Artificial Sequence: Synthetic Antisense oligonucleotide
  misc_feature (13)..(14): bicyclic nucleic acid (BNA)
tctgtccaagcccg

SEQ ID NO: 7641 - DNA, 13 bp, Artificial Sequence
  Description of Artificial Sequence: Synthetic Antisense oligonucleotide
  misc_feature (12)..(13): bicyclic nucleic acid (BNA)
tctgtccaagccc

SEQ ID NO: 7642 - DNA, 12 bp, Artificial Sequence
  Description of Artificial Sequence: Synthetic Antisense oligonucleotide
  misc_feature (11)..(12): bicyclic nucleic acid (BNA)
tctgtccaagcc

SEQ ID NO: 7643 - DNA, 11 bp, Artificial Sequence
  Description of Artificial Sequence: Synthetic Antisense oligonucleotide
  misc_feature (10)..(11): bicyclic nucleic acid (BNA)
tctgtccaagc

SEQ ID NO: 7644 - DNA, 10 bp, Artificial Sequence
  Description of Artificial Sequence: Synthetic Antisense oligonucleotide
  misc_feature (9)..(10): bicyclic nucleic acid (BNA)
tctgtccaag

SEQ ID NO: 7645 - DNA, 9 bp, Artificial Sequence
  Description of Artificial Sequence: Synthetic Antisense oligonucleotide
  misc_feature (8)..(9): bicyclic nucleic acid (BNA)
tctgtccaa

SEQ ID NO: 7646 - DNA, 8 bp, Artificial Sequence
  Description of Artificial Sequence: Synthetic Antisense oligonucleotide
  misc_feature (7)..(8): bicyclic nucleic acid (BNA)
tctgtcca

SEQ ID NO: 7647 - DNA, 17 bp, Artificial Sequence
  Description of Artificial Sequence: Synthetic Antisense oligonucleotide
  misc_feature (16)..(17): bicyclic nucleic acid (BNA)
ctgtccaagcccggttg

SEQ ID NO: 7648 - DNA, 16 bp, Artificial Sequence
  Description of Artificial Sequence: Synthetic Antisense oligonucleotide
  misc_feature (15)..(16): bicyclic nucleic acid (BNA)
ctgtccaagcccggtt

SEQ ID NO: 7649 - DNA, 15 bp, Artificial Sequence
  Description of Artificial Sequence: Synthetic Antisense oligonucleotide
  misc_feature (14)..(15): bicyclic nucleic acid (BNA)
ctgtccaagcccggt

SEQ ID NO: 7650 - DNA, 14 bp, Artificial Sequence
  Description of Artificial Sequence: Synthetic Antisense oligonucleotide
  misc_feature (13)..(14): bicyclic nucleic acid (BNA)
ctgtccaagcccgg

SEQ ID NO: 7651 - DNA, 13 bp, Artificial Sequence
  Description of Artificial Sequence: Synthetic Antisense oligonucleotide
  misc_feature (12)..(13): bicyclic nucleic acid (BNA)
ctgtccaagcccg

SEQ ID NO: 7652 - DNA, 12 bp, Artificial Sequence
  Description of Artificial Sequence: Synthetic Antisense oligonucleotide
  misc_feature (11)..(12): bicyclic nucleic acid (BNA)
ctgtccaagccc

SEQ ID NO: 7653 - DNA, 11 bp, Artificial Sequence
  Description of Artificial Sequence: Synthetic Antisense oligonucleotide
  misc_feature (10)..(11): bicyclic nucleic acid (BNA)
ctgtccaagcc

SEQ ID NO: 7654 - DNA, 10 bp, Artificial Sequence
  Description of Artificial Sequence: Synthetic Antisense oligonucleotide
  misc_feature (9)..(10): bicyclic nucleic acid (BNA)
ctgtccaagc

SEQ ID NO: 7655 - DNA, 9 bp, Artificial Sequence
  Description of Artificial Sequence: Synthetic Antisense oligonucleotide
  misc_feature (8)..(9): bicyclic nucleic acid (BNA)
ctgtccaag

SEQ ID NO: 7656 - DNA, 8 bp, Artificial Sequence
  Description of Artificial Sequence: Synthetic Antisense oligonucleotide
  misc_feature (7)..(8): bicyclic nucleic acid (BNA)
ctgtccaa

SEQ ID NO: 7657 - DNA, 20 bp, Artificial Sequence
  Description of Artificial Sequence: Synthetic Antisense oligonucleotide
  misc_feature (19)..(20): bicyclic nucleic acid (BNA)
gttctgtccaagcccggttg

SEQ ID NO: 7658 - DNA, 19 bp, Artificial Sequence
  Description of Artificial Sequence: Synthetic Antisense oligonucleotide
  misc_feature (18)..(19): bicyclic nucleic acid (BNA)
gttctgtccaagcccggtt

SEQ ID NO: 7659 - DNA, 18 bp, Artificial Sequence
  Description of Artificial Sequence: Synthetic Antisense oligonucleotide
  misc_feature (17)..(18): bicyclic nucleic acid (BNA)
gttctgtccaagcccggt

SEQ ID NO: 7660 - DNA, 17 bp, Artificial Sequence
  Description of Artificial Sequence: Synthetic Antisense oligonucleotide
  misc_feature (16)..(17): bicyclic nucleic acid (BNA)
gttctgtccaagcccgg

SEQ ID NO: 7661 - DNA, 16 bp, Artificial Sequence
  Description of Artificial Sequence: Synthetic Antisense oligonucleotide
  misc_feature (15)..(16): bicyclic nucleic acid (BNA)
gttctgtccaagcccg

SEQ ID NO: 7662 - DNA, 15 bp, Artificial Sequence
  Description of Artificial Sequence: Synthetic Antisense oligonucleotide
  misc_feature (14)..(15): bicyclic nucleic acid (BNA)
gttctgtccaagccc

SEQ ID NO: 7663 - DNA, 14 bp, Artificial Sequence
  Description of Artificial Sequence: Synthetic Antisense oligonucleotide
  misc_feature (13)..(14): bicyclic nucleic acid (BNA)
gttctgtccaagcc

SEQ ID NO: 7664 - DNA, 13 bp, Artificial Sequence
  Description of Artificial Sequence: Synthetic Antisense oligonucleotide
  misc_feature (12)..(13): bicyclic nucleic acid (BNA)
gttctgtccaagc

SEQ ID NO: 7665 - DNA, 12 bp, Artificial Sequence
  Description of Artificial Sequence: Synthetic Antisense oligonucleotide
  misc_feature (11)..(12): bicyclic nucleic acid (BNA)
gttctgtccaag

SEQ ID NO: 7666 - DNA, 11 bp, Artificial Sequence
  Description of Artificial Sequence: Synthetic Antisense oligonucleotide
  misc_feature (10)..(11): bicyclic nucleic acid (BNA)
gttctgtccaa

SEQ ID NO: 7667 - DNA, 10 bp, Artificial Sequence
  Description of Artificial Sequence: Synthetic Antisense oligonucleotide
  misc_feature (9)..(10): bicyclic nucleic acid (BNA)
gttctgtcca

SEQ ID NO: 7668 - DNA, 9 bp, Artificial Sequence
  Description of Artificial Sequence: Synthetic Antisense oligonucleotide
  misc_feature (8)..(9): bicyclic nucleic acid (BNA)
gttctgtcc

SEQ ID NO: 7669 - DNA, 8 bp, Artificial Sequence
  Description of Artificial Sequence: Synthetic Antisense oligonucleotide
  misc_feature (7)..(8): bicyclic nucleic acid (BNA)
gttctgtc

SEQ ID NO: 7670 - DNA, 20 bp, Artificial Sequence
  Description of Artificial Sequence: Synthetic Antisense oligonucleotide
  misc_feature (19)..(20): bicyclic nucleic acid (BNA)
agttctgtccaagcccggtt

SEQ ID NO: 7671 - DNA, 19 bp, Artificial Sequence
  Description of Artificial Sequence: Synthetic Antisense oligonucleotide
  misc_feature (18)..(19): bicyclic nucleic acid (BNA)
agttctgtccaagcccggt

SEQ ID NO: 7672 - DNA, 18 bp, Artificial Sequence
  Description of Artificial Sequence: Synthetic Antisense oligonucleotide
  misc_feature (17)..(18): bicyclic nucleic acid (BNA)
agttctgtccaagcccgg

SEQ ID NO: 7673 - DNA, 17 bp, Artificial Sequence
  Description of Artificial Sequence: Synthetic Antisense oligonucleotide
  misc_feature (16)..(17): bicyclic nucleic acid (BNA)
agttctgtccaagcccg

SEQ ID NO: 7674 - DNA, 16 bp, Artificial Sequence
  Description of Artificial Sequence: Synthetic Antisense oligonucleotide
  misc_feature (15)..(16): bicyclic nucleic acid (BNA)
agttctgtccaagccc

SEQ ID NO: 7675 - DNA, 15 bp, Artificial Sequence
  Description of Artificial Sequence: Synthetic Antisense oligonucleotide
  misc_feature (14)..(15): bicyclic nucleic acid (BNA)
agttctgtccaagcc

SEQ ID NO: 7676 - DNA, 14 bp, Artificial Sequence
  Description of Artificial Sequence: Synthetic Antisense oligonucleotide
  misc_feature (13)..(14): bicyclic nucleic acid (BNA)
agttctgtccaagc

SEQ ID NO: 7677 - DNA, 13 bp, Artificial Sequence
  Description of Artificial Sequence: Synthetic Antisense oligonucleotide
  misc_feature (12)..(13): bicyclic nucleic acid (BNA)
agttctgtccaag

SEQ ID NO: 7678 - DNA, 12 bp, Artificial Sequence
  Description of Artificial Sequence: Synthetic Antisense oligonucleotide
  misc_feature (11)..(12): bicyclic nucleic acid (BNA)
agttctgtccaa

SEQ ID NO: 7679 - DNA, 11 bp, Artificial Sequence
  Description of Artificial Sequence: Synthetic Antisense oligonucleotide
  misc_feature (10)..(11): bicyclic nucleic acid (BNA)
agttctgtcca

SEQ ID NO: 7680 - DNA, 10 bp, Artificial Sequence
  Description of Artificial Sequence: Synthetic Antisense oligonucleotide
  misc_feature (9)..(10): bicyclic nucleic acid (BNA)
agttctgtcc

SEQ ID NO: 7681 - DNA, 9 bp, Artificial Sequence
  Description of Artificial Sequence: Synthetic Antisense oligonucleotide
  misc_feature (8)..(9): bicyclic nucleic acid (BNA)
agttctgtc

SEQ ID NO: 7682 - DNA, 8 bp, Artificial Sequence
  Description of Artificial Sequence: Synthetic Antisense oligonucleotide
  misc_feature (7)..(8): bicyclic nucleic acid (BNA)
agttctgt

SEQ ID NO: 7683 - DNA, 20 bp, Artificial Sequence
  Description of Artificial Sequence: Synthetic Antisense oligonucleotide
  misc_feature (19)..(20): bicyclic nucleic acid (BNA)
aagttctgtccaagcccggt

SEQ ID NO: 7684 - DNA, 19 bp, Artificial Sequence
  Description of Artificial Sequence: Synthetic Antisense oligonucleotide
  misc_feature (18)..(19): bicyclic nucleic acid (BNA)
aagttctgtccaagcccgg

SEQ ID NO: 7685 - DNA, 18 bp, Artificial Sequence
  Description of Artificial Sequence: Synthetic Antisense oligonucleotide
  misc_feature (17)..(18): bicyclic nucleic acid (BNA)
aagttctgtccaagcccg

SEQ ID NO: 7686 - DNA, 17 bp, Artificial Sequence
  Description of Artificial Sequence: Synthetic Antisense oligonucleotide
  misc_feature (16)..(17): bicyclic nucleic acid (BNA)
aagttctgtccaagccc

SEQ ID NO: 7687 - DNA, 16 bp, Artificial Sequence
  Description of Artificial Sequence: Synthetic Antisense oligonucleotide
  misc_feature (15)..(16): bicyclic nucleic acid (BNA)
aagttctgtccaagcc

SEQ ID NO: 7688 - DNA, 15 bp, Artificial Sequence
  Description of Artificial Sequence: Synthetic Antisense oligonucleotide
  misc_feature (14)..(15): bicyclic nucleic acid (BNA)
aagttctgtccaagc

SEQ ID NO: 7689 - DNA, 14 bp, Artificial Sequence
  Description of Artificial Sequence: Synthetic Antisense oligonucleotide
  misc_feature (13)..(14): bicyclic nucleic acid (BNA)
aagttctgtccaag

SEQ ID NO: 7690 - DNA, 13 bp, Artificial Sequence
  Description of Artificial Sequence: Synthetic Antisense oligonucleotide
  misc_feature (12)..(13): bicyclic nucleic acid (BNA)
aagttctgtccaa

SEQ ID NO: 7691 - DNA, 12 bp, Artificial Sequence
  Description of Artificial Sequence: Synthetic Antisense oligonucleotide
  misc_feature (11)..(12): bicyclic nucleic acid (BNA)
aagttctgtcca

SEQ ID NO: 7692 - DNA, 11 bp, Artificial Sequence
  Description of Artificial Sequence: Synthetic Antisense oligonucleotide
  misc_feature (10)..(11): bicyclic nucleic acid (BNA)
aagttctgtcc

SEQ ID NO: 7693 - DNA, 10 bp, Artificial Sequence
  Description of Artificial Sequence: Synthetic Antisense oligonucleotide
  misc_feature (9)..(10): bicyclic nucleic acid (BNA)
aagttctgtc

SEQ ID NO: 7694 - DNA, 9 bp, Artificial Sequence
  Description of Artificial Sequence: Synthetic Antisense oligonucleotide
  misc_feature (8)..(9): bicyclic nucleic acid (BNA)
aagttctgt

SEQ ID NO: 7695 - DNA, 8 bp, Artificial Sequence
  Description of Artificial Sequence: Synthetic Antisense oligonucleotide
  misc_feature (7)..(8): bicyclic nucleic acid (BNA)
aagttctg

SEQ ID NO: 7696 - DNA, 20 bp, Artificial Sequence
  Description of Artificial Sequence: Synthetic Antisense oligonucleotide
  misc_feature (19)..(20): bicyclic nucleic acid (BNA)
taagttctgtccaagcccgg

SEQ ID NO: 7697 - DNA, 19 bp, Artificial Sequence
  Description of Artificial Sequence: Synthetic Antisense oligonucleotide
  misc_feature (18)..(19): bicyclic nucleic acid (BNA)
taagttctgtccaagcccg

SEQ ID NO: 7698 - DNA, 18 bp, Artificial Sequence
  Description of Artificial Sequence: Synthetic Antisense oligonucleotide
  misc_feature (17)..(18): bicyclic nucleic acid (BNA)
taagttctgtccaagccc

SEQ ID NO: 7699 - DNA, 17 bp, Artificial Sequence
  Description of Artificial Sequence: Synthetic Antisense oligonucleotide
  misc_feature (16)..(17): bicyclic nucleic acid (BNA)
taagttctgtccaagcc

SEQ ID NO: 7700 - DNA, 16 bp, Artificial Sequence
  Description of Artificial Sequence: Synthetic Antisense oligonucleotide
  misc_feature (15)..(16): bicyclic nucleic acid (BNA)
taagttctgtccaagc

SEQ ID NO: 7701 - DNA, 14 bp, Artificial Sequence
  Description of Artificial Sequence: Synthetic Antisense oligonucleotide
  misc_feature (13)..(14): bicyclic nucleic acid (BNA)
taagttctgtccaa

SEQ ID NO: 7702 - DNA, 13 bp, Artificial Sequence
  Description of Artificial Sequence: Synthetic Antisense oligonucleotide
  misc_feature (12)..(13): bicyclic nucleic acid (BNA)
taagttctgtcca

SEQ ID NO: 7703 - DNA, 12 bp, Artificial Sequence
  Description of Artificial Sequence: Synthetic Antisense oligonucleotide
  misc_feature (11)..(12): bicyclic nucleic acid (BNA)
taagttctgtcc

SEQ ID NO: 7704 - DNA, 11 bp, Artificial Sequence
  Description of Artificial Sequence: Synthetic Antisense oligonucleotide
  misc_feature (10)..(11): bicyclic nucleic acid (BNA)
taagttctgtc

SEQ ID NO: 7705 - DNA, 10 bp, Artificial Sequence
  Description of Artificial Sequence: Synthetic Antisense oligonucleotide
  misc_feature (9)..(10): bicyclic nucleic acid (BNA)
taagttctgt

SEQ ID NO: 7706 - DNA, 9 bp, Artificial Sequence
  Description of Artificial Sequence: Synthetic Antisense oligonucleotide
  misc_feature (8)..(9): bicyclic nucleic acid (BNA)
taagttctg

SEQ ID NO: 7707 - DNA, 8 bp, Artificial Sequence
  Description of Artificial Sequence: Synthetic Antisense oligonucleotide
  misc_feature (7)..(8): bicyclic nucleic acid (BNA)
taagttct

SEQ ID NO: 7708 - DNA, 20 bp, Artificial Sequence
  Description of Artificial Sequence: Synthetic Antisense oligonucleotide
  misc_feature (19)..(20): bicyclic nucleic acid (BNA)
gtaagttctgtccaagcccg

SEQ ID NO: 7709 - DNA, 19 bp, Artificial Sequence
  Description of Artificial Sequence: Synthetic Antisense oligonucleotide
  misc_feature (18)..(19): bicyclic nucleic acid (BNA)
gtaagttctgtccaagccc

SEQ ID NO: 7710 - DNA, 17 bp, Artificial Sequence
  Description of Artificial Sequence: Synthetic Antisense oligonucleotide
  misc_feature (16)..(17): bicyclic nucleic acid (BNA)
gtaagttctgtccaagc

SEQ ID NO: 7711 - DNA, 16 bp, Artificial Sequence
  Description of Artificial Sequence: Synthetic Antisense oligonucleotide
  misc_feature (15)..(16): bicyclic nucleic acid (BNA)
gtaagttctgtccaag

SEQ ID NO: 7712 - DNA, 15 bp, Artificial Sequence
  Description of Artificial Sequence: Synthetic Antisense oligonucleotide
  misc_feature (14)..(15): bicyclic nucleic acid (BNA)
gtaagttctgtccaa

SEQ ID NO: 7713 - DNA, 14 bp, Artificial Sequence
  Description of Artificial Sequence: Synthetic Antisense oligonucleotide
  misc_feature (13)..(14): bicyclic nucleic acid (BNA)
gtaagttctgtcca

SEQ ID NO: 7714 - DNA, 13 bp, Artificial Sequence
  Description of Artificial Sequence: Synthetic Antisense oligonucleotide
  misc_feature (12)..(13): bicyclic nucleic acid (BNA)
gtaagttctgtcc

SEQ ID NO: 7715 - DNA, 12 bp, Artificial Sequence
  Description of Artificial Sequence: Synthetic Antisense oligonucleotide
  misc_feature (11)..(12): bicyclic nucleic acid (BNA)
gtaagttctgtc

SEQ ID NO: 7716 - DNA, 11 bp, Artificial Sequence
  Description of Artificial Sequence: Synthetic Antisense oligonucleotide
  misc_feature (10)..(11): bicyclic nucleic acid (BNA)
gtaagttctgt

SEQ ID NO: 7717 - DNA, 10 bp, Artificial Sequence
  Description of Artificial Sequence: Synthetic Antisense oligonucleotide
  misc_feature (9)..(10): bicyclic nucleic acid (BNA)
gtaagttctg

SEQ ID NO: 7718 - DNA, 9 bp, Artificial Sequence
  Description of Artificial Sequence: Synthetic Antisense oligonucleotide
  misc_feature (8)..(9): bicyclic nucleic acid (BNA)
gtaagttct

SEQ ID NO: 7719 - DNA, 8 bp, Artificial Sequence
  Description of Artificial Sequence: Synthetic Antisense oligonucleotide
  misc_feature (7)..(8): bicyclic nucleic acid (BNA)
gtaagttc

SEQ ID NO: 7720 - DNA, 20 bp, Artificial Sequence
  Description of Artificial Sequence: Synthetic Antisense oligonucleotide
  misc_feature (19)..(20): bicyclic nucleic acid (BNA)
ggtaagttctgtccaagccc

SEQ ID NO: 7721 - DNA, 19 bp, Artificial Sequence
  Description of Artificial Sequence: Synthetic Antisense oligonucleotide
  misc_feature (18)..(19): bicyclic nucleic acid (BNA)
ggtaagttctgtccaagcc

SEQ ID NO: 7722 - DNA, 17 bp, Artificial Sequence
  Description of Artificial Sequence: Synthetic Antisense oligonucleotide
  misc_feature (16)..(17): bicyclic nucleic acid (BNA)
ggtaagttctgtccaag

SEQ ID NO: 7723 - DNA, 16 bp, Artificial Sequence
  Description of Artificial Sequence: Synthetic Antisense oligonucleotide
  misc_feature (15)..(16): bicyclic nucleic acid (BNA)
ggtaagttctgtccaa

SEQ ID NO: 7724 - DNA, 15 bp, Artificial Sequence
  Description of Artificial Sequence: Synthetic Antisense oligonucleotide
  misc_feature (14)..(15): bicyclic nucleic acid (BNA)
ggtaagttctgtcca

SEQ ID NO: 7725 - DNA, 14 bp, Artificial Sequence
  Description of Artificial Sequence: Synthetic Antisense oligonucleotide
  misc_feature (13)..(14): bicyclic nucleic acid (BNA)
ggtaagttctgtcc

SEQ ID NO: 7726 - DNA, 13 bp, Artificial Sequence
  Description of Artificial Sequence: Synthetic Antisense oligonucleotide
  misc_feature (12)..(13): bicyclic nucleic acid (BNA)
ggtaagttctgtc

SEQ ID NO: 7727 - DNA, 12 bp, Artificial Sequence
  Description of Artificial Sequence: Synthetic Antisense oligonucleotide
  misc_feature (11)..(12): bicyclic nucleic acid (BNA)
ggtaagttctgt

SEQ ID NO: 7728 - DNA, 11 bp, Artificial Sequence
  Description of Artificial Sequence: Synthetic Antisense oligonucleotide
  misc_feature (10)..(11): bicyclic nucleic acid (BNA)
ggtaagttctg

SEQ ID NO: 7729 - DNA, 10 bp, Artificial Sequence
  Description of Artificial Sequence: Synthetic Antisense oligonucleotide
  misc_feature (9)..(10): bicyclic nucleic acid (BNA)
ggtaagttct

SEQ ID NO: 7730 - DNA, 9 bp, Artificial Sequence
  Description of Artificial Sequence: Synthetic Antisense oligonucleotide
  misc_feature (8)..(9): bicyclic nucleic acid (BNA)
ggtaagttc

SEQ ID NO: 7731 - DNA, 8 bp, Artificial Sequence
  Description of Artificial Sequence: Synthetic Antisense oligonucleotide
  misc_feature (7)..(8): bicyclic nucleic acid (BNA)
ggtaagtt

SEQ ID NO: 7732 - DNA, 20 bp, Artificial Sequence
  Description of Artificial Sequence: Synthetic Antisense oligonucleotide
  misc_feature (19)..(20): bicyclic nucleic acid (BNA)
cggtaagttctgtccaagcc

SEQ ID NO: 7733 - DNA, 19 bp, Artificial Sequence
  Description of Artificial Sequence: Synthetic Antisense oligonucleotide
  misc_feature (18)..(19): bicyclic nucleic acid (BNA)
cggtaagttctgtccaagc

SEQ ID NO: 7734 - DNA, 18 bp, Artificial Sequence
  Description of Artificial Sequence: Synthetic Antisense oligonucleotide
  misc_feature (17)..(18): bicyclic nucleic acid (BNA)
cggtaagttctgtccaag

SEQ ID NO: 7735 - DNA, 17 bp, Artificial Sequence
  Description of Artificial Sequence: Synthetic Antisense oligonucleotide
  misc_feature (16)..(17): bicyclic nucleic acid (BNA)
cggtaagttctgtccaa

SEQ ID NO: 7736 - DNA, 16 bp, Artificial Sequence
  Description of Artificial Sequence: Synthetic Antisense oligonucleotide
  misc_feature (15)..(16): bicyclic nucleic acid (BNA)
cggtaagttctgtcca

SEQ ID NO: 7737 - DNA, 15 bp, Artificial Sequence
  Description of Artificial Sequence: Synthetic Antisense oligonucleotide
  misc_feature (14)..(15): bicyclic nucleic acid (BNA)
cggtaagttctgtcc

SEQ ID NO: 7738 - DNA, 14 bp, Artificial Sequence
  Description of Artificial Sequence: Synthetic Antisense oligonucleotide
  misc_feature (13)..(14): bicyclic nucleic acid (BNA)
cggtaagttctgtc

SEQ ID NO: 7739 - DNA, 13 bp, Artificial Sequence
  Description of Artificial Sequence: Synthetic Antisense oligonucleotide
  misc_feature (12)..(13): bicyclic nucleic acid (BNA)
cggtaagttctgt

SEQ ID NO: 7740 - DNA, 12 bp, Artificial Sequence
  Description of Artificial Sequence: Synthetic Antisense oligonucleotide
  misc_feature (11)..(12): bicyclic nucleic acid (BNA)
cggtaagttctg

SEQ ID NO: 7741 - DNA, 11 bp, Artificial Sequence
  Description of Artificial Sequence: Synthetic Antisense oligonucleotide
  misc_feature (10)..(11): bicyclic nucleic acid (BNA)
cggtaagttct

SEQ ID NO: 7742 - DNA, 10 bp, Artificial Sequence
  Description of Artificial Sequence: Synthetic Antisense oligonucleotide
  misc_feature (9)..(10): bicyclic nucleic acid (BNA)
cggtaagttc

SEQ ID NO: 7743 - DNA, 9 bp, Artificial Sequence
  Description of Artificial Sequence: Synthetic Antisense oligonucleotide
  misc_feature (8)..(9): bicyclic nucleic acid (BNA)
cggtaagtt

SEQ ID NO: 7744 - DNA, 8 bp, Artificial Sequence
  Description of Artificial Sequence: Synthetic Antisense oligonucleotide
  misc_feature (7)..(8): bicyclic nucleic acid (BNA)
cggtaagt

SEQ ID NO: 7745 - DNA, 20 bp, Artificial Sequence
  Description of Artificial Sequence: Synthetic Antisense oligonucleotide
  misc_feature (19)..(20): bicyclic nucleic acid (BNA)
tcggtaagttctgtccaagc

SEQ ID NO: 7746 - DNA, 19 bp, Artificial Sequence
  Description of Artificial Sequence: Synthetic Antisense oligonucleotide
  misc_feature (18)..(19): bicyclic nucleic acid (BNA)
tcggtaagttctgtccaag

SEQ ID NO: 7747 - DNA, 18 bp, Artificial Sequence
  Description of Artificial Sequence: Synthetic Antisense oligonucleotide
  misc_feature (17)..(18): bicyclic nucleic acid (BNA)
tcggtaagttctgtccaa

SEQ ID NO: 7748 - DNA, 17 bp, Artificial Sequence
  Description of Artificial Sequence: Synthetic Antisense oligonucleotide
  misc_feature (16)..(17): bicyclic nucleic acid (BNA)
tcggtaagttctgtcca

SEQ ID NO: 7749 - DNA, 16 bp, Artificial Sequence
  Description of Artificial Sequence: Synthetic Antisense oligonucleotide
  misc_feature (15)..(16): bicyclic nucleic acid (BNA)
tcggtaagttctgtcc

SEQ ID NO: 7750 - DNA, 15 bp, Artificial Sequence
  Description of Artificial Sequence: Synthetic Antisense oligonucleotide
  misc_feature (14)..(15): bicyclic nucleic acid (BNA)
tcggtaagttctgtc

SEQ ID NO: 7751 - DNA, 14 bp, Artificial Sequence
  Description of Artificial Sequence: Synthetic Antisense oligonucleotide
  misc_feature (13)..(14): bicyclic nucleic acid (BNA)
tcggtaagttctgt

SEQ ID NO: 7752 - DNA, 13 bp, Artificial Sequence
  Description of Artificial Sequence: Synthetic Antisense oligonucleotide
  misc_feature (12)..(13): bicyclic nucleic acid (BNA)
tcggtaagttctg

SEQ ID NO: 7753 - DNA, 12 bp, Artificial Sequence
  Description of Artificial Sequence: Synthetic Antisense oligonucleotide
  misc_feature (11)..(12): bicyclic nucleic acid (BNA)
tcggtaagttct

SEQ ID NO: 7754 - DNA, 11 bp, Artificial Sequence
  Description of Artificial Sequence: Synthetic Antisense oligonucleotide
  misc_feature (10)..(11): bicyclic nucleic acid (BNA)
tcggtaagttc

SEQ ID NO: 7755 - DNA, 10 bp, Artificial Sequence
  Description of Artificial Sequence: Synthetic Antisense oligonucleotide
  misc_feature (9)..(10): bicyclic nucleic acid (BNA)
tcggtaagtt

SEQ ID NO: 7756 - DNA, 9 bp, Artificial Sequence
  Description of Artificial Sequence: Synthetic Antisense oligonucleotide
  misc_feature (8)..(9): bicyclic nucleic acid (BNA)
tcggtaagt

SEQ ID NO: 7757 - DNA, 20 bp, Artificial Sequence
  Description of Artificial Sequence: Synthetic Antisense oligonucleotide
  misc_feature (19)..(20): bicyclic nucleic acid (BNA)
gtcggtaagttctgtccaag

SEQ ID NO: 7758 - DNA, 19 bp, Artificial Sequence
  Description of Artificial Sequence: Synthetic Antisense oligonucleotide
  misc_feature (18)..(19): bicyclic nucleic acid (BNA)
gtcggtaagttctgtccaa

SEQ ID NO: 7759 - DNA, 18 bp, Artificial Sequence
  Description of Artificial Sequence: Synthetic Antisense oligonucleotide
  misc_feature (17)..(18): bicyclic nucleic acid (BNA)
gtcggtaagttctgtcca

SEQ ID NO: 7760 - DNA, 17 bp, Artificial Sequence
  Description of Artificial Sequence: Synthetic Antisense oligonucleotide
  misc_feature (16)..(17): bicyclic nucleic acid (BNA)
gtcggtaagttctgtcc

SEQ ID NO: 7761 - DNA, 16 bp, Artificial Sequence
  Description of Artificial Sequence: Synthetic Antisense oligonucleotide
  misc_feature (15)..(16): bicyclic nucleic acid (BNA)
gtcggtaagttctgtc

SEQ ID NO: 7762 - DNA, 15 bp, Artificial Sequence
  Description of Artificial Sequence: Synthetic Antisense oligonucleotide
  misc_feature (14)..(15): bicyclic nucleic acid (BNA)
gtcggtaagttctgt

SEQ ID NO: 7763 - DNA, 14 bp, Artificial Sequence
  Description of Artificial Sequence: Synthetic Antisense oligonucleotide
  misc_feature (13)..(14): bicyclic nucleic acid (BNA)
gtcggtaagttctg

SEQ ID NO: 7764 - DNA, 13 bp, Artificial Sequence
  Description of Artificial Sequence: Synthetic Antisense oligonucleotide
  misc_feature (12)..(13): bicyclic nucleic acid (BNA)
gtcggtaagttct

SEQ ID NO: 7765 - DNA, 12 bp, Artificial Sequence
  Description of Artificial Sequence: Synthetic Antisense oligonucleotide
  misc_feature (11)..(12): bicyclic nucleic acid (BNA)
gtcggtaagttc

SEQ ID NO: 7766 - DNA, 11 bp, Artificial Sequence
  Description of Artificial Sequence: Synthetic Antisense oligonucleotide
  misc_feature (10)..(11): bicyclic nucleic acid (BNA)
gtcggtaagtt

SEQ ID NO: 7767 - DNA, 10 bp, Artificial Sequence
  Description of Artificial Sequence: Synthetic Antisense oligonucleotide
  misc_feature (9)..(10): bicyclic nucleic acid (BNA)
gtcggtaagt

SEQ ID NO: 7768 - DNA, 20 bp, Artificial Sequence
  Description of Artificial Sequence: Synthetic Antisense oligonucleotide
  misc_feature (19)..(20): bicyclic nucleic acid (BNA)
agtcggtaagttctgtccaa

SEQ ID NO: 7769 - DNA, 19 bp, Artificial Sequence
  Description of Artificial Sequence: Synthetic Antisense oligonucleotide
  misc_feature (18)..(19): bicyclic nucleic acid (BNA)
agtcggtaagttctgtcca

SEQ ID NO: 7770 - DNA, 17 bp, Artificial Sequence
  Description of Artificial Sequence: Synthetic Antisense oligonucleotide
  misc_feature (16)..(17): bicyclic nucleic acid (BNA)
agtcggtaagttctgtc

SEQ ID NO: 7771 - DNA, 16 bp, Artificial Sequence
  Description of Artificial Sequence: Synthetic Antisense oligonucleotide
  misc_feature (15)..(16): bicyclic nucleic acid (BNA)
agtcggtaagttctgt

SEQ ID NO: 7772 - DNA, 15 bp, Artificial Sequence
  Description of Artificial Sequence: Synthetic Antisense oligonucleotide
  misc_feature (14)..(15): bicyclic nucleic acid (BNA)
agtcggtaagttctg

SEQ ID NO: 7773 - DNA, 14 bp, Artificial Sequence
  Description of Artificial Sequence: Synthetic Antisense oligonucleotide
  misc_feature (13)..(14): bicyclic nucleic acid (BNA)
agtcggtaagttct

SEQ ID NO: 7774 - DNA, 13 bp, Artificial Sequence
  Description of Artificial Sequence: Synthetic Antisense oligonucleotide
  misc_feature (12)..(13): bicyclic nucleic acid (BNA)
agtcggtaagttc

SEQ ID NO: 7775 - DNA, 12 bp, Artificial Sequence
  Description of Artificial Sequence: Synthetic Antisense oligonucleotide
  misc_feature (11)..(12): bicyclic nucleic acid (BNA)
agtcggtaagtt

SEQ ID NO: 7776 - DNA, 11 bp, Artificial Sequence
  Description of Artificial Sequence: Synthetic Antisense oligonucleotide
  misc_feature (10)..(11): bicyclic nucleic acid (BNA)
agtcggtaagt

SEQ ID NO: 7777 - DNA, 20 bp, Artificial Sequence
  Description of Artificial Sequence: Synthetic Antisense oligonucleotide
  misc_feature (19)..(20): bicyclic nucleic acid (BNA)
cagtcggtaagttctgtcca

SEQ ID NO: 7778 - DNA, 19 bp, Artificial Sequence
  Description of Artificial Sequence: Synthetic Antisense oligonucleotide
  misc_feature (18)..(19): bicyclic nucleic acid (BNA)
cagtcggtaagttctgtcc

SEQ ID NO: 7779 - DNA, 18 bp, Artificial Sequence
  Description of Artificial Sequence: Synthetic Antisense oligonucleotide
  misc_feature (17)..(18): bicyclic nucleic acid (BNA)
cagtcggtaagttctgtc

SEQ ID NO: 7780 - DNA, 17 bp, Artificial Sequence
  Description of Artificial Sequence: Synthetic Antisense oligonucleotide
  misc_feature (16)..(17): bicyclic nucleic acid (BNA)
cagtcggtaagttctgt

SEQ ID NO: 7781 - DNA, 16 bp, Artificial Sequence
  Description of Artificial Sequence: Synthetic Antisense oligonucleotide
  misc_feature (15)..(16): bicyclic nucleic acid (BNA)
cagtcggtaagttctg

SEQ ID NO: 7782 - DNA, 15 bp, Artificial Sequence
  Description of Artificial Sequence: Synthetic Antisense oligonucleotide
  misc_feature (14)..(15): bicyclic nucleic acid (BNA)
cagtcggtaagttct

SEQ ID NO: 7783 - DNA, 14 bp, Artificial Sequence
  Description of Artificial Sequence: Synthetic Antisense oligonucleotide
  misc_feature (13)..(14): bicyclic nucleic acid (BNA)
cagtcggtaagttc

SEQ ID NO: 7784 - DNA, 13 bp, Artificial Sequence
  Description of Artificial Sequence: Synthetic Antisense oligonucleotide
  misc_feature (12)..(13): bicyclic nucleic acid (BNA)
cagtcggtaagtt

SEQ ID NO: 7785 - DNA, 12 bp, Artificial Sequence
  Description of Artificial Sequence: Synthetic Antisense oligonucleotide
  misc_feature (11)..(12): bicyclic nucleic acid (BNA)
cagtcggtaagt

SEQ ID NO: 7786 - DNA, 20 bp, Artificial Sequence
  Description of Artificial Sequence: Synthetic Antisense oligonucleotide
  misc_feature (19)..(20): bicyclic nucleic acid (BNA)
ccagtcggtaagttctgtcc

SEQ ID NO: 7787 - DNA, 19 bp, Artificial Sequence
  Description of Artificial Sequence: Synthetic Antisense oligonucleotide
  misc_feature (18)..(19): bicyclic nucleic acid (BNA)
ccagtcggtaagttctgtc

SEQ ID NO: 7788 - DNA, 18 bp, Artificial Sequence
  Description of Artificial Sequence: Synthetic Antisense oligonucleotide
  misc_feature (17)..(18): bicyclic nucleic acid (BNA)
ccagtcggtaagttctgt

SEQ ID NO: 7789 - DNA, 17 bp, Artificial Sequence
  Description of Artificial Sequence: Synthetic Antisense oligonucleotide
  misc_feature (16)..(17): bicyclic nucleic acid (BNA)
ccagtcggtaagttctg

SEQ ID NO: 7790 - DNA, 16 bp, Artificial Sequence
  Description of Artificial Sequence: Synthetic Antisense oligonucleotide
  misc_feature (15)..(16): bicyclic nucleic acid (BNA)
ccagtcggtaagttct

SEQ ID NO: 7791 - DNA, 15 bp, Artificial Sequence
  Description of Artificial Sequence: Synthetic Antisense oligonucleotide
  misc_feature (14)..(15): bicyclic nucleic acid (BNA)
ccagtcggtaagttc

SEQ ID NO: 7792 - DNA, 14 bp, Artificial Sequence
  Description of Artificial Sequence: Synthetic Antisense oligonucleotide
  misc_feature (13)..(14): bicyclic nucleic acid (BNA)
ccagtcggtaagtt

SEQ ID NO: 7793 - DNA, 13 bp, Artificial Sequence
  Description of Artificial Sequence: Synthetic Antisense oligonucleotide
  misc_feature (12)..(13): bicyclic nucleic acid (BNA)
ccagtcggtaagt

SEQ ID NO: 7794 - DNA, 20 bp, Artificial Sequence
  Description of Artificial Sequence: Synthetic Antisense oligonucleotide
  misc_feature (19)..(20): bicyclic nucleic acid (BNA)
gccagtcggtaagttctgtc

SEQ ID NO: 7795 - DNA, 19 bp, Artificial Sequence
  Description of Artificial Sequence: Synthetic Antisense oligonucleotide
  misc_feature (18)..(19): bicyclic nucleic acid (BNA)
gccagtcggtaagttctgt

SEQ ID NO: 7796 - DNA, 18 bp, Artificial Sequence
  Description of Artificial Sequence: Synthetic Antisense oligonucleotide
  misc_feature (17)..(18): bicyclic nucleic acid (BNA)
gccagtcggtaagttctg

SEQ ID NO: 7797 - DNA, 17 bp, Artificial Sequence
  Description of Artificial Sequence: Synthetic Antisense oligonucleotide
  misc_feature (16)..(17): bicyclic nucleic acid (BNA)
gccagtcggtaagttct

SEQ ID NO: 7798 - DNA, 16 bp, Artificial Sequence
  Description of Artificial Sequence: Synthetic Antisense oligonucleotide
  misc_feature (15)..(16): bicyclic nucleic acid (BNA)
gccagtcggtaagttc

SEQ ID NO: 7799 - DNA, 15 bp, Artificial Sequence
  Description of Artificial Sequence: Synthetic Antisense oligonucleotide
  misc_feature (14)..(15): bicyclic nucleic acid (BNA)
gccagtcggtaagtt

SEQ ID NO: 7800 - DNA, 14 bp, Artificial Sequence
  Description of Artificial Sequence: Synthetic Antisense oligonucleotide
  misc_feature (13)..(14): bicyclic nucleic acid (BNA)
gccagtcggtaagt

SEQ ID NO: 7801 - DNA, 20 bp, Artificial Sequence
  Description of Artificial Sequence: Synthetic Antisense oligonucleotide
  misc_feature (19)..(20): bicyclic nucleic acid (BNA)
tcaaggaagatggcatttct

SEQ ID NO: 7802 - DNA, 22 bp, Artificial Sequence
  Description of Artificial Sequence: Synthetic Antisense oligonucleotide
  misc_feature (21)..(22): bicyclic nucleic acid (BNA)
tcaaggaagatggcatttctag

SEQ ID NO: 7803 - DNA, 16 bp, Artificial Sequence
  Description of Artificial Sequence: Synthetic Antisense oligonucleotide
  misc_feature (15)..(16): bicyclic nucleic acid (BNA)
tcaaggaagatggcat

SEQ ID NO: 7804 - DNA, 15 bp, Artificial Sequence
  Description of Artificial Sequence: Synthetic Antisense oligonucleotide
  misc_feature (14)..(15): bicyclic nucleic acid (BNA)
gaagatggcatttct

SEQ ID NO: 7805 - DNA, 21 bp, Artificial Sequence
  Description of Artificial Sequence: Synthetic Antisense oligonucleotide
  misc_feature (20)..(21): bicyclic nucleic acid (BNA)
tcaaggaagatggcatttcta

SEQ ID NO: 7806 - DNA, 19 bp, Artificial Sequence
  Description of Artificial Sequence: Synthetic Antisense oligonucleotide
  misc_feature (18)..(19): bicyclic nucleic acid (BNA)
tcaaggaagatggcatttc

SEQ ID NO: 7807 - DNA, 18 bp, Artificial Sequence
  Description of Artificial Sequence: Synthetic Antisense oligonucleotide
  misc_feature (17)..(18): bicyclic nucleic acid (BNA)
tcaaggaagatggcattt

SEQ ID NO: 7808 - DNA, 17 bp, Artificial Sequence
  Description of Artificial Sequence: Synthetic Antisense oligonucleotide
  misc_feature (16)..(17): bicyclic nucleic acid (BNA)
tcaaggaagatggcatt

SEQ ID NO: 7809 - DNA, 15 bp, Artificial Sequence
  Description of Artificial Sequence: Synthetic Antisense oligonucleotide
  misc_feature (14)..(15): bicyclic nucleic acid (BNA)
tcaaggaagatggca

SEQ ID NO: 7810 - DNA, 14 bp, Artificial Sequence
  Description of Artificial Sequence: Synthetic Antisense oligonucleotide
  misc_feature (13)..(14): bicyclic nucleic acid (BNA)
tcaaggaagatggc

SEQ ID NO: 7811 - DNA, 13 bp, Artificial Sequence
  Description of Artificial Sequence: Synthetic Antisense oligonucleotide
  misc_feature (12)..(13): bicyclic nucleic acid (BNA)
tcaaggaagatgg

SEQ ID NO: 7812 - DNA, 12 bp, Artificial Sequence
  Description of Artificial Sequence: Synthetic Antisense oligonucleotide
  misc_feature (11)..(12): bicyclic nucleic acid (BNA)
tcaaggaagatg

SEQ ID NO: 7813 - DNA, 11 bp, Artificial Sequence
  Description of Artificial Sequence: Synthetic Antisense oligonucleotide
  misc_feature (10)..(11): bicyclic nucleic acid (BNA)
tcaaggaagat

SEQ ID NO: 7814 - DNA, 10 bp, Artificial Sequence
  Description of Artificial Sequence: Synthetic Antisense oligonucleotide
  misc_feature (9)..(10): bicyclic nucleic acid (BNA)
tcaaggaaga

SEQ ID NO: 7815 - DNA, 9 bp, Artificial Sequence
  Description of Artificial Sequence: Synthetic Antisense oligonucleotide
  misc_feature (8)..(9): bicyclic nucleic acid (BNA)
tcaaggaag

SEQ ID NO: 7816 - DNA, 21 bp, Artificial Sequence
  Description of Artificial Sequence: Synthetic Antisense oligonucleotide
  misc_feature (20)..(21): bicyclic nucleic acid (BNA)
caaggaagatggcatttctag

SEQ ID NO: 7817 - DNA, 20 bp, Artificial Sequence
  Description of Artificial Sequence: Synthetic Antisense oligonucleotide
  misc_feature (19)..(20): bicyclic nucleic acid (BNA)
caaggaagatggcatttcta

SEQ ID NO: 7818 - DNA, 19 bp, Artificial Sequence
  Description of Artificial Sequence: Synthetic Antisense oligonucleotide
  misc_feature (18)..(19): bicyclic nucleic acid (BNA)
caaggaagatggcatttct

SEQ ID NO: 7819 - DNA, 18 bp, Artificial Sequence
  Description of Artificial Sequence: Synthetic Antisense oligonucleotide
  misc_feature (17)..(18): bicyclic nucleic acid (BNA)
caaggaagatggcatttc

SEQ ID NO: 7820 - DNA, 17 bp, Artificial Sequence
  Description of Artificial Sequence: Synthetic Antisense oligonucleotide
  misc_feature (16)..(17): bicyclic nucleic acid (BNA)
caaggaagatggcattt

SEQ ID NO: 7821 - DNA, 16 bp, Artificial Sequence
  Description of Artificial Sequence: Synthetic Antisense oligonucleotide
  misc_feature (15)..(16): bicyclic nucleic acid (BNA)
caaggaagatggcatt

SEQ ID NO: 7822 - DNA, 15 bp, Artificial Sequence
  Description of Artificial Sequence: Synthetic Antisense oligonucleotide
  misc_feature (14)..(15): bicyclic nucleic acid (BNA)
caaggaagatggcat

SEQ ID NO: 7823 - DNA, 14 bp, Artificial Sequence
  Description of Artificial Sequence: Synthetic Antisense oligonucleotide
  misc_feature (13)..(14): bicyclic nucleic acid (BNA)
caaggaagatggca

SEQ ID NO: 7824 - DNA, 13 bp, Artificial Sequence
  Description of Artificial Sequence: Synthetic Antisense oligonucleotide
  misc_feature (12)..(13): bicyclic nucleic acid (BNA)
caaggaagatggc

SEQ ID NO: 7825 - DNA, 12 bp, Artificial Sequence
  Description of Artificial Sequence: Synthetic Antisense oligonucleotide
  misc_feature (11)..(12): bicyclic nucleic acid (BNA)
caaggaagatgg

SEQ ID NO: 7826 - DNA, 11 bp, Artificial Sequence
  Description of Artificial Sequence: Synthetic Antisense oligonucleotide
  misc_feature (10)..(11): bicyclic nucleic acid (BNA)
caaggaagatg

SEQ ID NO: 7827 - DNA, 10 bp, Artificial Sequence
  Description of Artificial Sequence: Synthetic Antisense oligonucleotide
  misc_feature (9)..(10): bicyclic nucleic acid (BNA)
caaggaagat

SEQ ID NO: 7828 - DNA, 20 bp, Artificial Sequence
  Description of Artificial Sequence: Synthetic Antisense oligonucleotide
  misc_feature (19)..(20): bicyclic nucleic acid (BNA)
aaggaagatggcatttctag

SEQ ID NO: 7829 - DNA, 19 bp, Artificial Sequence
  Description of Artificial Sequence: Synthetic Antisense oligonucleotide
  misc_feature (18)..(19): bicyclic nucleic acid (BNA)
aaggaagatggcatttcta

SEQ ID NO: 7830 - DNA, 18 bp, Artificial Sequence
  Description of Artificial Sequence: Synthetic Antisense oligonucleotide
  misc_feature (17)..(18): bicyclic nucleic acid (BNA)
aaggaagatggcatttct

SEQ ID NO: 7831 - DNA, 17 bp, Artificial Sequence
  Description of Artificial Sequence: Synthetic Antisense oligonucleotide
  misc_feature (16)..(17): bicyclic nucleic acid (BNA)
aaggaagatggcatttc

SEQ ID NO: 7832 - DNA, 16 bp, Artificial Sequence
  Description of Artificial Sequence: Synthetic Antisense oligonucleotide
  misc_feature (15)..(16): bicyclic nucleic acid (BNA)
aaggaagatggcattt

SEQ ID NO: 7833 - DNA, 15 bp, Artificial Sequence
  Description of Artificial Sequence: Synthetic Antisense oligonucleotide
  misc_feature (14)..(15): bicyclic nucleic acid (BNA)
aaggaagatggcatt

SEQ ID NO: 7834 - DNA, 14 bp, Artificial Sequence
  Description of Artificial Sequence: Synthetic Antisense oligonucleotide
  misc_feature (13)..(14): bicyclic nucleic acid (BNA)
aaggaagatggcat

SEQ ID NO: 7835 - DNA, 13 bp, Artificial Sequence
  Description of Artificial Sequence: Synthetic Antisense oligonucleotide
  misc_feature (12)..(13): bicyclic nucleic acid (BNA)
aaggaagatggca

SEQ ID NO: 7836 - DNA, 12 bp, Artificial Sequence
  Description of Artificial Sequence: Synthetic Antisense oligonucleotide
  misc_feature (11)..(12): bicyclic nucleic acid (BNA)
aaggaagatggc

SEQ ID NO: 7837 - DNA, 11 bp, Artificial Sequence
  Description of Artificial Sequence: Synthetic Antisense oligonucleotide
  misc_feature (10)..(11): bicyclic nucleic acid (BNA)
aaggaagatgg

SEQ ID NO: 7838 - DNA, 10 bp, Artificial Sequence
  Description of Artificial Sequence: Synthetic Antisense oligonucleotide
  misc_feature (9)..(10): bicyclic nucleic acid (BNA)
aaggaagatg

SEQ ID NO: 7839 - DNA, 9 bp, Artificial Sequence
  Description of Artificial Sequence: Synthetic Antisense oligonucleotide
  misc_feature (8)..(9): bicyclic nucleic acid (BNA)
aaggaagat

SEQ ID NO: 7840 - DNA, 19 bp, Artificial Sequence
  Description of Artificial Sequence: Synthetic Antisense oligonucleotide
  misc_feature (18)..(19): bicyclic nucleic acid (BNA)
aggaagatggcatttctag

SEQ ID NO: 7841 - DNA, 18 bp, Artificial Sequence
  Description of Artificial Sequence: Synthetic Antisense oligonucleotide
  misc_feature (17)..(18): bicyclic nucleic acid (BNA)
aggaagatggcatttcta

SEQ ID NO: 7842 - DNA, 17 bp, Artificial Sequence
  Description of Artificial Sequence: Synthetic Antisense oligonucleotide
  misc_feature (16)..(17): bicyclic nucleic acid (BNA)
aggaagatggcatttct

SEQ ID NO: 7843 - DNA, 16 bp, Artificial Sequence
  Description of Artificial Sequence: Synthetic Antisense oligonucleotide
  misc_feature (15)..(16): bicyclic nucleic acid (BNA)
aggaagatggcatttc

SEQ ID NO: 7844 - DNA, 15 bp, Artificial Sequence
  Description of Artificial Sequence: Synthetic Antisense oligonucleotide
  misc_feature (14)..(15): bicyclic nucleic acid (BNA)
aggaagatggcattt

SEQ ID NO: 7845 - DNA, 14 bp, Artificial Sequence
  Description of Artificial Sequence: Synthetic Antisense oligonucleotide
  misc_feature (13)..(14): bicyclic nucleic acid (BNA)
aggaagatggcatt

SEQ ID NO: 7846 - DNA, 13 bp, Artificial Sequence
  Description of Artificial Sequence: Synthetic Antisense oligonucleotide
  misc_feature (12)..(13): bicyclic nucleic acid (BNA)
aggaagatggcat

SEQ ID NO: 7847 - DNA, 12 bp, Artificial Sequence
  Description of Artificial Sequence: Synthetic Antisense oligonucleotide
  misc_feature (11)..(12): bicyclic nucleic acid (BNA)
aggaagatggca

SEQ ID NO: 7848 - DNA, 10 bp, Artificial Sequence
  Description of Artificial Sequence: Synthetic Antisense oligonucleotide
  misc_feature (9)..(10): bicyclic nucleic acid (BNA)
aggaagatgg

SEQ ID NO: 7849 - DNA, 9 bp, Artificial Sequence
  Description of Artificial Sequence: Synthetic Antisense oligonucleotide
  misc_feature (8)..(9): bicyclic nucleic acid (BNA)
aggaagatg

SEQ ID NO: 7850 - DNA, 8 bp, Artificial Sequence
  Description of Artificial Sequence: Synthetic Antisense oligonucleotide
  misc_feature (7)..(8): bicyclic nucleic acid (BNA)
aggaagat

SEQ ID NO: 7851 - DNA, 18 bp, Artificial Sequence
  Description of Artificial Sequence: Synthetic Antisense oligonucleotide
  misc_feature (17)..(18): bicyclic nucleic acid (BNA)
ggaagatggcatttctag

SEQ ID NO: 7852 - DNA, 17 bp, Artificial Sequence
  Description of Artificial Sequence: Synthetic Antisense oligonucleotide
  misc_feature (16)..(17): bicyclic nucleic acid (BNA)
ggaagatggcatttcta

SEQ ID NO: 7853 - DNA, 16 bp, Artificial Sequence
  Description of Artificial Sequence: Synthetic Antisense oligonucleotide
  misc_feature (15)..(16): bicyclic nucleic acid (BNA)
ggaagatggcatttct

SEQ ID NO: 7854 - DNA, 15 bp, Artificial Sequence
  Description of Artificial Sequence: Synthetic Antisense oligonucleotide
  misc_feature (14)..(15): bicyclic nucleic acid (BNA)
ggaagatggcatttc

SEQ ID NO: 7855 - DNA, 14 bp, Artificial Sequence
  Description of Artificial Sequence: Synthetic Antisense oligonucleotide
  misc_feature (13)..(14): bicyclic nucleic acid (BNA)
ggaagatggcattt

SEQ ID NO: 7856 - DNA, 13 bp, Artificial Sequence
  Description of Artificial Sequence: Synthetic Antisense oligonucleotide
  misc_feature (12)..(13): bicyclic nucleic acid (BNA)
ggaagatggcatt

SEQ ID NO: 7857 - DNA, 12 bp, Artificial Sequence
  Description of Artificial Sequence: Synthetic Antisense oligonucleotide
  misc_feature (11)..(12): bicyclic nucleic acid (BNA)
ggaagatggcat

SEQ ID NO: 7858 - DNA, 11 bp, Artificial Sequence
  Description of Artificial Sequence: Synthetic Antisense oligonucleotide
  misc_feature (10)..(11): bicyclic nucleic acid (BNA)
ggaagatggca

SEQ ID NO: 7859 - DNA, 10 bp, Artificial Sequence
  Description of Artificial Sequence: Synthetic Antisense oligonucleotide
  misc_feature (9)..(10): bicyclic nucleic acid (BNA)
ggaagatggc

SEQ ID NO: 7860 - DNA, 8 bp, Artificial Sequence
  Description of Artificial Sequence: Synthetic Antisense oligonucleotide
  misc_feature (7)..(8): bicyclic nucleic acid (BNA)
ggaagatg

SEQ ID NO: 7861 - DNA, 17 bp, Artificial Sequence
  Description of Artificial Sequence: Synthetic Antisense oligonucleotide
  misc_feature (16)..(17): bicyclic nucleic acid (BNA)
gaagatggcatttctag

SEQ ID NO: 7862 - DNA, 16 bp, Artificial Sequence
  Description of Artificial Sequence: Synthetic Antisense oligonucleotide
  misc_feature (15)..(16): bicyclic nucleic acid (BNA)
gaagatggcatttcta

SEQ ID NO: 7863 - DNA, 14 bp, Artificial Sequence
  Description of Artificial Sequence: Synthetic Antisense oligonucleotide
  misc_feature (13)..(14): bicyclic nucleic acid (BNA)
gaagatggcatttc

SEQ ID NO: 7864 - DNA, 13 bp, Artificial Sequence
  Description of Artificial Sequence: Synthetic Antisense oligonucleotide
  misc_feature (12)..(13): bicyclic nucleic acid (BNA)
gaagatggcattt

SEQ ID NO: 7865 - DNA, 12 bp, Artificial Sequence
  Description of Artificial Sequence: Synthetic Antisense oligonucleotide
  misc_feature (11)..(12): bicyclic nucleic acid (BNA)
gaagatggcatt

SEQ ID NO: 7866 - DNA, 11 bp, Artificial Sequence
  Description of Artificial Sequence: Synthetic Antisense oligonucleotide
  misc_feature (10)..(11): bicyclic nucleic acid (BNA)
gaagatggcat

SEQ ID NO: 7867 - DNA, 10 bp, Artificial Sequence
  Description of Artificial Sequence: Synthetic Antisense oligonucleotide
  misc_feature (9)..(10): bicyclic nucleic acid (BNA)
gaagatggca

SEQ ID NO: 7868 - DNA, 9 bp, Artificial Sequence
  Description of Artificial Sequence: Synthetic Antisense oligonucleotide
  misc_feature (8)..(9): bicyclic nucleic acid (BNA)
gaagatggc

SEQ ID NO: 7869 - DNA, 8 bp, Artificial Sequence
  Description of Artificial Sequence: Synthetic Antisense oligonucleotide
  misc_feature (7)..(8): bicyclic nucleic acid (BNA)
gaagatgg

SEQ ID NO: 7870 - DNA, 16 bp, Artificial Sequence
  Description of Artificial Sequence: Synthetic Antisense oligonucleotide
  misc_feature (15)..(16): bicyclic nucleic acid (BNA)
aagatggcatttctag

SEQ ID NO: 7871 - DNA, 15 bp, Artificial Sequence
  Description of Artificial Sequence: Synthetic Antisense oligonucleotide
  misc_feature (14)..(15): bicyclic nucleic acid (BNA)
aagatggcatttcta

SEQ ID NO: 7872 - DNA, 14 bp, Artificial Sequence
  Description of Artificial Sequence: Synthetic Antisense oligonucleotide
  misc_feature (13)..(14): bicyclic nucleic acid (BNA)
aagatggcatttct

SEQ ID NO: 7873 - DNA, 13 bp, Artificial Sequence
  Description of Artificial Sequence: Synthetic Antisense oligonucleotide
  misc_feature (12)..(13): bicyclic nucleic acid (BNA)
aagatggcatttc

SEQ ID NO: 7874 - DNA, 12 bp, Artificial Sequence
  Description of Artificial Sequence: Synthetic Antisense oligonucleotide
  misc_feature (11)..(12): bicyclic nucleic acid (BNA)
aagatggcattt

SEQ ID NO: 7875 - DNA, 11 bp, Artificial Sequence
  Description of Artificial Sequence: Synthetic Antisense oligonucleotide
  misc_feature (10)..(11): bicyclic nucleic acid (BNA)
aagatggcatt

SEQ ID NO: 7876 - DNA, 10 bp, Artificial Sequence
  Description of Artificial Sequence: Synthetic Antisense oligonucleotide
  misc_feature (9)..(10): bicyclic nucleic acid (BNA)
aagatggcat

SEQ ID NO: 7877 - DNA, 9 bp, Artificial Sequence
  Description of Artificial Sequence: Synthetic Antisense oligonucleotide
  misc_feature (8)..(9): bicyclic nucleic acid (BNA)
aagatggca

SEQ ID NO: 7878 - DNA, 8 bp, Artificial Sequence
  Description of Artificial Sequence: Synthetic Antisense oligonucleotide
  misc_feature (7)..(8): bicyclic nucleic acid (BNA)
aagatggc

SEQ ID NO: 7879 - DNA, 15 bp, Artificial Sequence
  Description of Artificial Sequence: Synthetic Antisense oligonucleotide
  misc_feature (14)..(15): bicyclic nucleic acid (BNA)
agatggcatttctag

SEQ ID NO: 7880 - DNA, 14 bp, Artificial Sequence
  Description of Artificial Sequence: Synthetic Antisense oligonucleotide
  misc_feature (13)..(14): bicyclic nucleic acid (BNA)
agatggcatttcta

SEQ ID NO: 7881 - DNA, 13 bp, Artificial Sequence
  Description of Artificial Sequence: Synthetic Antisense oligonucleotide
  misc_feature (12)..(13): bicyclic nucleic acid (BNA)
agatggcatttct

SEQ ID NO: 7882 - DNA, 12 bp, Artificial Sequence
  Description of Artificial Sequence: Synthetic Antisense oligonucleotide
  misc_feature (11)..(12): bicyclic nucleic acid (BNA)
agatggcatttc

SEQ ID NO: 7883 - DNA, 11 bp, Artificial Sequence
  Description of Artificial Sequence: Synthetic Antisense oligonucleotide
  misc_feature (10)..(11): bicyclic nucleic acid (BNA)
agatggcattt

SEQ ID NO: 7884 - DNA, 10 bp, Artificial Sequence
  Description of Artificial Sequence: Synthetic Antisense oligonucleotide
  misc_feature (9)..(10): bicyclic nucleic acid (BNA)
agatggcatt

SEQ ID NO: 7885 - DNA, 9 bp, Artificial Sequence
  Description of Artificial Sequence: Synthetic Antisense oligonucleotide
  misc_feature (8)..(9): bicyclic nucleic acid (BNA)
agatggcat

SEQ ID NO: 7886 - DNA, 8 bp, Artificial Sequence
  Description of Artificial Sequence: Synthetic Antisense oligonucleotide
  misc_feature (7)..(8): bicyclic nucleic acid (BNA)
agatggca

SEQ ID NO: 7887 - DNA, 30 bp, Artificial Sequence; identical to SEQ ID NO: 8
  Description of Artificial Sequence: Synthetic Antisense oligonucleotide
  misc_feature (29)..(30): bicyclic nucleic acid (BNA)

SEQ ID NO: 7888 - DNA, 29 bp, Artificial Sequence
  Description of Artificial Sequence: Synthetic Antisense oligonucleotide
  misc_feature (28)..(29): bicyclic nucleic acid (BNA)
ctccaacatcaaggaagatggcatttcta

SEQ ID NO: 7889 - DNA, 28 bp, Artificial Sequence
  Description of Artificial Sequence: Synthetic Antisense oligonucleotide
  misc_feature (27)..(28): bicyclic nucleic acid (BNA)
ctccaacatcaaggaagatggcatttct

SEQ ID NO: 7890 - DNA, 27 bp, Artificial Sequence
  Description of Artificial Sequence: Synthetic Antisense oligonucleotide
  misc_feature (26)..(27): bicyclic nucleic acid (BNA)
ctccaacatcaaggaagatggcatttc

SEQ ID NO: 7891 - DNA, 26 bp, Artificial Sequence
  Description of Artificial Sequence: Synthetic Antisense oligonucleotide
  misc_feature (25)..(26): bicyclic nucleic acid (BNA)
ctccaacatcaaggaagatggcattt

SEQ ID NO: 7892 - DNA, 25 bp, Artificial Sequence
  Description of Artificial Sequence: Synthetic Antisense oligonucleotide
  misc_feature (24)..(25): bicyclic nucleic acid (BNA)
ctccaacatcaaggaagatggcatt

SEQ ID NO: 7893 - DNA, 24 bp, Artificial Sequence
  Description of Artificial Sequence: Synthetic Antisense oligonucleotide
  misc_feature (23)..(24): bicyclic nucleic acid (BNA)
ctccaacatcaaggaagatggcat

SEQ ID NO: 7894 - DNA, 23 bp, Artificial Sequence
  Description of Artificial Sequence: Synthetic Antisense oligonucleotide
  misc_feature (22)..(23): bicyclic nucleic acid (BNA)
ctccaacatcaaggaagatggca

SEQ ID NO: 7895 - DNA, 22 bp, Artificial Sequence
  Description of Artificial Sequence: Synthetic Antisense oligonucleotide
  misc_feature (21)..(22): bicyclic nucleic acid (BNA)
ctccaacatcaaggaagatggc

SEQ ID NO: 7896 - DNA, 21 bp, Artificial Sequence
  Description of Artificial Sequence: Synthetic Antisense oligonucleotide
  misc_feature (20)..(21): bicyclic nucleic acid (BNA)
ctccaacatcaaggaagatgg

SEQ ID NO: 7897 - DNA, 20 bp, Artificial Sequence
  Description of Artificial Sequence: Synthetic Antisense oligonucleotide
  misc_feature (19)..(20): bicyclic nucleic acid (BNA)
ctccaacatcaaggaagatg

SEQ ID NO: 7898 - DNA, 19 bp, Artificial Sequence
  Description of Artificial Sequence: Synthetic Antisense oligonucleotide
  misc_feature (18)..(19): bicyclic nucleic acid (BNA)
ctccaacatcaaggaagat

SEQ ID NO: 7899 - DNA, 18 bp, Artificial Sequence
  Description of Artificial Sequence: Synthetic Antisense oligonucleotide
  misc_feature (17)..(18): bicyclic nucleic acid (BNA)
ctccaacatcaaggaaga

SEQ ID NO: 7900 - DNA, 17 bp, Artificial Sequence
  Description of Artificial Sequence: Synthetic Antisense oligonucleotide
  misc_feature (16)..(17): bicyclic nucleic acid (BNA)
ctccaacatcaaggaag

SEQ ID NO: 7901 - DNA, 29 bp, Artificial Sequence
  Description of Artificial Sequence: Synthetic Antisense oligonucleotide
  misc_feature (28)..(29): bicyclic nucleic acid (BNA)
tccaacatcaaggaagatggcatttctag

SEQ ID NO: 7902 - DNA, 28 bp, Artificial Sequence
  Description of Artificial Sequence: Synthetic Antisense oligonucleotide
  misc_feature (27)..(28): bicyclic nucleic acid (BNA)
tccaacatcaaggaagatggcatttcta

SEQ ID NO: 7903 - DNA, 27 bp, Artificial Sequence
  Description of Artificial Sequence: Synthetic Antisense oligonucleotide
  misc_feature (26)..(27): bicyclic nucleic acid (BNA)
tccaacatcaaggaagatggcatttct

SEQ ID NO: 7904 - DNA, 26 bp, Artificial Sequence
  Description of Artificial Sequence: Synthetic Antisense oligonucleotide
  misc_feature (25)..(26): bicyclic nucleic acid (BNA)
tccaacatcaaggaagatggcatttc

SEQ ID NO: 7905 - DNA, 25 bp, Artificial Sequence
  Description of Artificial Sequence: Synthetic Antisense oligonucleotide
  misc_feature (24)..(25): bicyclic nucleic acid (BNA)
tccaacatcaaggaagatggcattt

SEQ ID NO: 7906 - DNA, 24 bp, Artificial Sequence
  Description of Artificial Sequence: Synthetic Antisense oligonucleotide
  misc_feature (23)..(24): bicyclic nucleic acid (BNA)
tccaacatcaaggaagatggcatt

SEQ ID NO: 7907 - DNA, 23 bp, Artificial Sequence
  Description of Artificial Sequence: Synthetic Antisense oligonucleotide
  misc_feature (22)..(23): bicyclic nucleic acid (BNA)
tccaacatcaaggaagatggcat

SEQ ID NO: 7908 - DNA, 22 bp, Artificial Sequence
  Description of Artificial Sequence: Synthetic Antisense oligonucleotide
  misc_feature (21)..(22): bicyclic nucleic acid (BNA)
tccaacatcaaggaagatggca

SEQ ID NO: 7909 - DNA, 21 bp, Artificial Sequence
  Description of Artificial Sequence: Synthetic Antisense oligonucleotide
  misc_feature (20)..(21): bicyclic nucleic acid (BNA)
tccaacatcaaggaagatggc

SEQ ID NO: 7910 - DNA, 20 bp, Artificial Sequence
  Description of Artificial Sequence: Synthetic Antisense oligonucleotide
  misc_feature (19)..(20): bicyclic nucleic acid (BNA)
tccaacatcaaggaagatgg

SEQ ID NO: 7911 - DNA, 19 bp, Artificial Sequence
  Description of Artificial Sequence: Synthetic Antisense oligonucleotide
  misc_feature (18)..(19): bicyclic nucleic acid (BNA)
tccaacatcaaggaagatg

SEQ ID NO: 7912 - DNA, 18 bp, Artificial Sequence
  Description of Artificial Sequence: Synthetic Antisense oligonucleotide
  misc_feature (17)..(18): bicyclic nucleic acid (BNA)
tccaacatcaaggaagat

SEQ ID NO: 7913 - DNA, 17 bp, Artificial Sequence
  Description of Artificial Sequence: Synthetic Antisense oligonucleotide
  misc_feature (16)..(17): bicyclic nucleic acid (BNA)
tccaacatcaaggaaga

SEQ ID NO: 7914 - DNA, 16 bp, Artificial Sequence
  Description of Artificial Sequence: Synthetic Antisense oligonucleotide
  misc_feature (15)..(16): bicyclic nucleic acid (BNA)
tccaacatcaaggaag

SEQ ID NO: 7915 - DNA, 28 bp, Artificial Sequence
  Description of Artificial Sequence: Synthetic Antisense oligonucleotide
  misc_feature (27)..(28): bicyclic nucleic acid (BNA)
ccaacatcaaggaagatggcatttctag

SEQ ID NO: 7916 - DNA, 27 bp, Artificial Sequence
  Description of Artificial Sequence: Synthetic Antisense oligonucleotide
  misc_feature (26)..(27): bicyclic nucleic acid (BNA)
ccaacatcaaggaagatggcatttcta

SEQ ID NO: 7917 - DNA, 26 bp, Artificial Sequence
  Description of Artificial Sequence: Synthetic Antisense oligonucleotide
  misc_feature (25)..(26): bicyclic nucleic acid (BNA)
ccaacatcaaggaagatggcatttct

SEQ ID NO: 7918 - DNA, 25 bp, Artificial Sequence
  Description of Artificial Sequence: Synthetic Antisense oligonucleotide
  misc_feature (24)..(25): bicyclic nucleic acid (BNA)
ccaacatcaaggaagatggcatttc

SEQ ID NO: 7919 - DNA, 24 bp, Artificial Sequence
  Description of Artificial Sequence: Synthetic Antisense oligonucleotide
  misc_feature (23)..(24): bicyclic nucleic acid (BNA)
ccaacatcaaggaagatggcattt

SEQ ID NO: 7920 - DNA, 23 bp, Artificial Sequence
  Description of Artificial Sequence: Synthetic Antisense oligonucleotide
  misc_feature (22)..(23): bicyclic nucleic acid (BNA)
ccaacatcaaggaagatggcatt

SEQ ID NO: 7921 - DNA, 22 bp, Artificial Sequence
  Description of Artificial Sequence: Synthetic Antisense oligonucleotide
  misc_feature (21)..(22): bicyclic nucleic acid (BNA)
ccaacatcaaggaagatggcat

SEQ ID NO: 7922 - DNA, 21 bp, Artificial Sequence
  Description of Artificial Sequence: Synthetic Antisense oligonucleotide
  misc_feature (20)..(21): bicyclic nucleic acid (BNA)
ccaacatcaaggaagatggca

SEQ ID NO: 7923 - DNA, 20 bp, Artificial Sequence
  Description of Artificial Sequence: Synthetic Antisense oligonucleotide
  misc_feature (19)..(20): bicyclic nucleic acid (BNA)
ccaacatcaaggaagatggc

SEQ ID NO: 7924 - DNA, 19 bp, Artificial Sequence
  Description of Artificial Sequence: Synthetic Antisense oligonucleotide
  misc_feature (18)..(19): bicyclic nucleic acid (BNA)
ccaacatcaaggaagatgg

SEQ ID NO: 7925 - DNA, 18 bp, Artificial Sequence
  Description of Artificial Sequence: Synthetic Antisense oligonucleotide
  misc_feature (17)..(18): bicyclic nucleic acid (BNA)
ccaacatcaaggaagatg

SEQ ID NO: 7926 - DNA, 17 bp, Artificial Sequence
  Description of Artificial Sequence: Synthetic Antisense oligonucleotide
  misc_feature (16)..(17): bicyclic nucleic acid (BNA)
ccaacatcaaggaagat

SEQ ID NO: 7927 - DNA, 16 bp, Artificial Sequence
  Description of Artificial Sequence: Synthetic Antisense oligonucleotide
  misc_feature (15)..(16): bicyclic nucleic acid (BNA)
ccaacatcaaggaaga

SEQ ID NO: 7928 - DNA, 15 bp, Artificial Sequence
  Description of Artificial Sequence: Synthetic Antisense oligonucleotide
  misc_feature (14)..(15): bicyclic nucleic acid (BNA)
ccaacatcaaggaag

SEQ ID NO: 7929 - DNA, 27 bp, Artificial Sequence
  Description of Artificial Sequence: Synthetic Antisense oligonucleotide
  misc_feature (26)..(27): bicyclic nucleic acid (BNA)
caacatcaaggaagatggcatttctag

SEQ ID NO: 7930 - DNA, 26 bp, Artificial Sequence
  Description of Artificial Sequence: Synthetic Antisense oligonucleotide
  misc_feature (25)..(26): bicyclic nucleic acid (BNA)
caacatcaaggaagatggcatttcta

SEQ ID NO: 7931 - DNA, 25 bp, Artificial Sequence
  Description of Artificial Sequence: Synthetic Antisense oligonucleotide
  misc_feature (24)..(25): bicyclic nucleic acid (BNA)
caacatcaaggaagatggcatttct

SEQ ID NO: 7932 - DNA, 24 bp, Artificial Sequence
  Description of Artificial Sequence: Synthetic Antisense oligonucleotide
  misc_feature (23)..(24): bicyclic nucleic acid (BNA)
caacatcaaggaagatggcatttc

SEQ ID NO: 7933 - DNA, 23 bp, Artificial Sequence
  Description of Artificial Sequence: Synthetic Antisense oligonucleotide
  misc_feature (22)..(23): bicyclic nucleic acid (BNA)
caacatcaaggaagatggcattt

SEQ ID NO: 7934 - DNA, 22 bp, Artificial Sequence
  Description of Artificial Sequence: Synthetic Antisense oligonucleotide
  misc_feature (21)..(22): bicyclic nucleic acid (BNA)
caacatcaaggaagatggcatt

SEQ ID NO: 7935 - DNA, 21 bp, Artificial Sequence
  Description of Artificial Sequence: Synthetic Antisense oligonucleotide
  misc_feature (20)..(21): bicyclic nucleic acid (BNA)
caacatcaaggaagatggcat

SEQ ID NO: 7936 - DNA, 20 bp, Artificial Sequence
  Description of Artificial Sequence: Synthetic Antisense oligonucleotide
  misc_feature (19)..(20): bicyclic nucleic acid (BNA)
caacatcaaggaagatggca

SEQ ID NO: 7937 - DNA, 19 bp, Artificial Sequence
  Description of Artificial Sequence: Synthetic Antisense oligonucleotide
  misc_feature (18)..(19): bicyclic nucleic acid (BNA)
caacatcaaggaagatggc

SEQ ID NO: 7938 - DNA, 18 bp, Artificial Sequence
  Description of Artificial Sequence: Synthetic Antisense oligonucleotide
  misc_feature (17)..(18): bicyclic nucleic acid (BNA)
caacatcaaggaagatgg

SEQ ID NO: 7939 - DNA, 17 bp, Artificial Sequence
  Description of Artificial Sequence: Synthetic Antisense oligonucleotide
  misc_feature (16)..(17): bicyclic nucleic acid (BNA)
caacatcaaggaagatg

SEQ ID NO: 7940 - DNA, 16 bp, Artificial Sequence
  Description of Artificial Sequence: Synthetic Antisense oligonucleotide
  misc_feature (15)..(16): bicyclic nucleic acid (BNA)
caacatcaaggaagat

SEQ ID NO: 7941 - DNA, 15 bp, Artificial Sequence
  Description of Artificial Sequence: Synthetic Antisense oligonucleotide
  misc_feature (14)..(15): bicyclic nucleic acid (BNA)
caacatcaaggaaga

SEQ ID NO: 7942 - DNA, 14 bp, Artificial Sequence
  Description of Artificial Sequence: Synthetic Antisense oligonucleotide
  misc_feature (13)..(14): bicyclic nucleic acid (BNA)
caacatcaaggaag

SEQ ID NO: 7943 - DNA, 26 bp, Artificial Sequence
  Description of Artificial Sequence: Synthetic Antisense oligonucleotide
  misc_feature (25)..(26): bicyclic nucleic acid (BNA)
aacatcaaggaagatggcatttctag

SEQ ID NO: 7944 - DNA, 25 bp, Artificial Sequence
  Description of Artificial Sequence: Synthetic Antisense oligonucleotide
  misc_feature (24)..(25): bicyclic nucleic acid (BNA)
aacatcaaggaagatggcatttcta

SEQ ID NO: 7945 - DNA, 24 bp, Artificial Sequence
  Description of Artificial Sequence: Synthetic Antisense oligonucleotide
  misc_feature (23)..(24): bicyclic nucleic acid (BNA)
aacatcaaggaagatggcatttct

SEQ ID NO: 7946 - DNA, 23 bp, Artificial Sequence
  Description of Artificial Sequence: Synthetic Antisense oligonucleotide
  misc_feature (22)..(23): bicyclic nucleic acid (BNA)
aacatcaaggaagatggcatttc

SEQ ID NO: 7947 - DNA, 22 bp, Artificial Sequence
  Description of Artificial Sequence: Synthetic Antisense oligonucleotide
  misc_feature (21)..(22): bicyclic nucleic acid (BNA)
aacatcaaggaagatggcattt

SEQ ID NO: 7948 - DNA, 21 bp, Artificial Sequence
  Description of Artificial Sequence: Synthetic Antisense oligonucleotide
  misc_feature (20)..(21): bicyclic nucleic acid (BNA)
aacatcaaggaagatggcatt

SEQ ID NO: 7949 - DNA, 20 bp, Artificial Sequence
  Description of Artificial Sequence: Synthetic Antisense oligonucleotide
  misc_feature (19)..(20): bicyclic nucleic acid (BNA)
aacatcaaggaagatggcat

SEQ ID NO: 7950 - DNA, 19 bp, Artificial Sequence
  Description of Artificial Sequence: Synthetic Antisense oligonucleotide
  misc_feature (18)..(19): bicyclic nucleic acid (BNA)
aacatcaaggaagatggca

SEQ ID NO: 7951 - DNA, 18 bp, Artificial Sequence
  Description of Artificial Sequence: Synthetic Antisense oligonucleotide
  misc_feature (17)..(18): bicyclic nucleic acid (BNA)
aacatcaaggaagatggc

SEQ ID NO: 7952 - DNA, 17 bp, Artificial Sequence
  Description of Artificial Sequence: Synthetic Antisense oligonucleotide
  misc_feature (16)..(17): bicyclic nucleic acid (BNA)
aacatcaaggaagatgg

SEQ ID NO: 7953 - DNA, 16 bp, Artificial Sequence
  Description of Artificial Sequence: Synthetic Antisense oligonucleotide
  misc_feature (15)..(16): bicyclic nucleic acid (BNA)
aacatcaaggaagatg

SEQ ID NO: 7954 - DNA, 15 bp, Artificial Sequence
  Description of Artificial Sequence: Synthetic Antisense oligonucleotide
  misc_feature (14)..(15): bicyclic nucleic acid (BNA)
aacatcaaggaagat

SEQ ID NO: 7955 - DNA, 14 bp, Artificial Sequence
  Description of Artificial Sequence: Synthetic Antisense oligonucleotide
  misc_feature (13)..(14): bicyclic nucleic acid (BNA)
aacatcaaggaaga

SEQ ID NO: 7956 - DNA, 13 bp, Artificial Sequence
  Description of Artificial Sequence: Synthetic Antisense oligonucleotide
  misc_feature (12)..(13): bicyclic nucleic acid (BNA)
aacatcaaggaag

SEQ ID NO: 7957 - DNA, 25 bp, Artificial Sequence
  Description of Artificial Sequence: Synthetic Antisense oligonucleotide
  misc_feature (24)..(25): bicyclic nucleic acid (BNA)
acatcaaggaagatggcatttctag

SEQ ID NO: 7958 - DNA, 24 bp, Artificial Sequence
  Description of Artificial Sequence: Synthetic Antisense oligonucleotide
  misc_feature (23)..(24): bicyclic nucleic acid (BNA)
acatcaaggaagatggcatttcta

SEQ ID NO: 7959 - DNA, 23 bp, Artificial Sequence
  Description of Artificial Sequence: Synthetic Antisense oligonucleotide
  misc_feature (22)..(23): bicyclic nucleic acid (BNA)
acatcaaggaagatggcatttct

SEQ ID NO: 7960 - DNA, 22 bp, Artificial Sequence
  Description of Artificial Sequence: Synthetic Antisense oligonucleotide
  misc_feature (21)..(22): bicyclic nucleic acid (BNA)
acatcaaggaagatggcatttc

SEQ ID NO: 7961 - DNA, 21 bp, Artificial Sequence
  Description of Artificial Sequence: Synthetic Antisense oligonucleotide
  misc_feature (20)..(21): bicyclic nucleic acid (BNA)
acatcaaggaagatggcattt

SEQ ID NO: 7962 - DNA, 20 bp, Artificial Sequence
  Description of Artificial Sequence: Synthetic Antisense oligonucleotide
  misc_feature (19)..(20): bicyclic nucleic acid (BNA)
acatcaaggaagatggcatt

SEQ ID NO: 7963 - DNA, 19 bp, Artificial Sequence
  Description of Artificial Sequence: Synthetic Antisense oligonucleotide
  misc_feature (18)..(19): bicyclic nucleic acid (BNA)
acatcaaggaagatggcat

SEQ ID NO: 7964 - DNA, 18 bp, Artificial Sequence
  Description of Artificial Sequence: Synthetic Antisense oligonucleotide
  misc_feature (17)..(18): bicyclic nucleic acid (BNA)
acatcaaggaagatggca

SEQ ID NO: 7965 - DNA, 17 bp, Artificial Sequence
  Description of Artificial Sequence: Synthetic Antisense oligonucleotide
  misc_feature (16)..(17): bicyclic nucleic acid (BNA)
acatcaaggaagatggc

SEQ ID NO: 7966 - DNA, 16 bp, Artificial Sequence
  Description of Artificial Sequence: Synthetic Antisense oligonucleotide
  misc_feature (15)..(16): bicyclic nucleic acid (BNA)
acatcaaggaagatgg

SEQ ID NO: 7967 - DNA, 15 bp, Artificial Sequence
  Description of Artificial Sequence: Synthetic Antisense oligonucleotide
  misc_feature (14)..(15): bicyclic nucleic acid (BNA)
acatcaaggaagatg

SEQ ID NO: 7968 - DNA, 14 bp, Artificial Sequence
  Description of Artificial Sequence: Synthetic Antisense oligonucleotide
  misc_feature (13)..(14): bicyclic nucleic acid (BNA)
acatcaaggaagat

SEQ ID NO: 7969 - DNA, 13 bp, Artificial Sequence
  Description of Artificial Sequence: Synthetic Antisense oligonucleotide
  misc_feature (12)..(13): bicyclic nucleic acid (BNA)
acatcaaggaaga

SEQ ID NO: 7970 - DNA, 12 bp, Artificial Sequence
  Description of Artificial Sequence: Synthetic Antisense oligonucleotide
  misc_feature (11)..(12): bicyclic nucleic acid (BNA)
acatcaaggaag

SEQ ID NO: 7971 - DNA, 24 bp, Artificial Sequence
  Description of Artificial Sequence: Synthetic Antisense oligonucleotide
  misc_feature (23)..(24): bicyclic nucleic acid (BNA)
catcaaggaagatggcatttctag

SEQ ID NO: 7972 - DNA, 23 bp, Artificial Sequence
  Description of Artificial Sequence: Synthetic Antisense oligonucleotide
  misc_feature (22)..(23): bicyclic nucleic acid (BNA)
catcaaggaagatggcatttcta

SEQ ID NO: 7973 - DNA, 22 bp, Artificial Sequence
  Description of Artificial Sequence: Synthetic Antisense oligonucleotide
  misc_feature (21)..(22): bicyclic nucleic acid (BNA)
catcaaggaagatggcatttct

SEQ ID NO: 7974 - DNA, 21 bp, Artificial Sequence
  Description of Artificial Sequence: Synthetic Antisense oligonucleotide
  misc_feature (20)..(21): bicyclic nucleic acid (BNA)
catcaaggaagatggcatttc

SEQ ID NO: 7975 - DNA, 20 bp, Artificial Sequence
  Description of Artificial Sequence: Synthetic Antisense oligonucleotide
  misc_feature (19)..(20): bicyclic nucleic acid (BNA)
catcaaggaagatggcattt

SEQ ID NO: 7976 - DNA, 19 bp, Artificial Sequence
  Description of Artificial Sequence: Synthetic Antisense oligonucleotide
  misc_feature (18)..(19): bicyclic nucleic acid (BNA)
catcaaggaagatggcatt

SEQ ID NO: 7977 - DNA, 18 bp, Artificial Sequence
  Description of Artificial Sequence: Synthetic Antisense oligonucleotide
  misc_feature (17)..(18): bicyclic nucleic acid (BNA)
catcaaggaagatggcat

SEQ ID NO: 7978 - DNA, 17 bp, Artificial Sequence
  Description of Artificial Sequence: Synthetic Antisense oligonucleotide
  misc_feature (16)..(17): bicyclic nucleic acid (BNA)
catcaaggaagatggca

SEQ ID NO: 7979 - DNA, 16 bp, Artificial Sequence
  Description of Artificial Sequence: Synthetic Antisense oligonucleotide
  misc_feature (15)..(16): bicyclic nucleic acid (BNA)
catcaaggaagatggc

SEQ ID NO: 7980 - DNA, 15 bp, Artificial Sequence
  Description of Artificial Sequence: Synthetic Antisense oligonucleotide
  misc_feature (14)..(15): bicyclic nucleic acid (BNA)
catcaaggaagatgg

SEQ ID NO: 7981 - DNA, 14 bp, Artificial Sequence
  Description of Artificial Sequence: Synthetic Antisense oligonucleotide
  misc_feature (13)..(14): bicyclic nucleic acid (BNA)
catcaaggaagatg

SEQ ID NO: 7982 - DNA, 13 bp, Artificial Sequence
  Description of Artificial Sequence: Synthetic Antisense oligonucleotide
  misc_feature (12)..(13): bicyclic nucleic acid (BNA)
catcaaggaagat

SEQ ID NO: 7983 - DNA, 12 bp, Artificial Sequence
  Description of Artificial Sequence: Synthetic Antisense oligonucleotide
  misc_feature (11)..(12): bicyclic nucleic acid (BNA)
catcaaggaaga

SEQ ID NO: 7984 - DNA, 11 bp, Artificial Sequence
  Description of Artificial Sequence: Synthetic Antisense oligonucleotide
  misc_feature (10)..(11): bicyclic nucleic acid (BNA)
catcaaggaag

SEQ ID NO: 7985 - DNA, 23 bp, Artificial Sequence
  Description of Artificial Sequence: Synthetic Antisense oligonucleotide
  misc_feature (22)..(23): bicyclic nucleic acid (BNA)
atcaaggaagatggcatttctag

SEQ ID NO: 7986 - DNA, 22 bp, Artificial Sequence
  Description of Artificial Sequence: Synthetic Antisense oligonucleotide
  misc_feature (21)..(22): bicyclic nucleic acid (BNA)
atcaaggaagatggcatttcta

SEQ ID NO: 7987 - DNA, 21 bp, Artificial Sequence
  Description of Artificial Sequence: Synthetic Antisense oligonucleotide
  misc_feature (20)..(21): bicyclic nucleic acid (BNA)
atcaaggaagatggcatttct

SEQ ID NO: 7988 - DNA, 20 bp, Artificial Sequence
  Description of Artificial Sequence: Synthetic Antisense oligonucleotide
  misc_feature (19)..(20): bicyclic nucleic acid (BNA)
atcaaggaagatggcatttc

SEQ ID NO: 7989 - DNA, 19 bp, Artificial Sequence
  Description of Artificial Sequence: Synthetic Antisense oligonucleotide
  misc_feature (18)..(19): bicyclic nucleic acid (BNA)
atcaaggaagatggcattt

SEQ ID NO: 7990 - DNA, 18 bp, Artificial Sequence
  Description of Artificial Sequence: Synthetic Antisense oligonucleotide
  misc_feature (17)..(18): bicyclic nucleic acid (BNA)
atcaaggaagatggcatt

SEQ ID NO: 7991 - DNA, 17 bp, Artificial Sequence
  Description of Artificial Sequence: Synthetic Antisense oligonucleotide
  misc_feature (16)..(17): bicyclic nucleic acid (BNA)
atcaaggaagatggcat

SEQ ID NO: 7992 - DNA, 16 bp, Artificial Sequence
  Description of Artificial Sequence: Synthetic Antisense oligonucleotide
  misc_feature (15)..(16): bicyclic nucleic acid (BNA)
atcaaggaagatggca

SEQ ID NO: 7993 - DNA, 15 bp, Artificial Sequence
  Description of Artificial Sequence: Synthetic Antisense oligonucleotide
  misc_feature (14)..(15): bicyclic nucleic acid (BNA)
atcaaggaagatggc

SEQ ID NO: 7994 - DNA, 14 bp, Artificial Sequence
  Description of Artificial Sequence: Synthetic Antisense oligonucleotide
  misc_feature (13)..(14): bicyclic nucleic acid (BNA)
atcaaggaagatgg

SEQ ID NO: 7995 - DNA, 13 bp, Artificial Sequence
  Description of Artificial Sequence: Synthetic Antisense oligonucleotide
  misc_feature (12)..(13): bicyclic nucleic acid (BNA)
atcaaggaagatg

SEQ ID NO: 7996 - DNA, 12 bp, Artificial Sequence
  Description of Artificial Sequence: Synthetic Antisense oligonucleotide
  misc_feature (11)..(12): bicyclic nucleic acid (BNA)
atcaaggaagat

SEQ ID NO: 7997 - DNA, 11 bp, Artificial Sequence
  Description of Artificial Sequence: Synthetic Antisense oligonucleotide
  misc_feature (10)..(11): bicyclic nucleic acid (BNA)
atcaaggaaga

SEQ ID NO: 7998 - DNA, 10 bp, Artificial Sequence
  Description of Artificial Sequence: Synthetic Antisense oligonucleotide
  misc_feature (9)..(10): bicyclic nucleic acid (BNA)
atcaaggaag

SEQ ID NO: 7999 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
ggtaagttctgtccaagc

SEQ ID NO: 8000 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
gtaagttctgtccaagcc

SEQ ID NO: 8001 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
agtcggtaagttctgtcc

SEQ ID NO: 8002 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
ctgtccaagcccggttga

SEQ ID NO: 8003 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
taagttctgtccaag

SEQ ID NO: 8004 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
ttctgtccaagcccggttga

SEQ ID NO: 8005 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
ttctgtccaagcccggttg

SEQ ID NO: 8006 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
ttctgtccaagcccggtt

SEQ ID NO: 8007 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
ttctgtccaagcccggt

SEQ ID NO: 8008 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
ttctgtccaagcccgg

SEQ ID NO: 8009 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
ttctgtccaagcccg

SEQ ID NO: 8010 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
ttctgtccaagccc

SEQ ID NO: 8011 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
ttctgtccaagcc

SEQ ID NO: 8012 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
ttctgtccaagc

SEQ ID NO: 8013 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
ttctgtccaag

SEQ ID NO: 8014 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
ttctgtccaa

SEQ ID NO: 8015 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
ttctgtcca

SEQ ID NO: 8016 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
ttctgtcc

SEQ ID NO: 8017 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
tctgtccaagcccggttga

SEQ ID NO: 8018 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
tctgtccaagcccggttg

SEQ ID NO: 8019 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
tctgtccaagcccggtt

SEQ ID NO: 8020 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
tctgtccaagcccggt

SEQ ID NO: 8021 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
tctgtccaagcccgg

SEQ ID NO: 8022 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
tctgtccaagcccg

SEQ ID NO: 8023 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
tctgtccaagccc

SEQ ID NO: 8024 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
tctgtccaagcc

SEQ ID NO: 8025 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
tctgtccaagc

SEQ ID NO: 8026 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
tctgtccaag

SEQ ID NO: 8027 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
tctgtccaa

SEQ ID NO: 8028 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
tctgtcca

SEQ ID NO: 8029 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
ctgtccaagcccggttg

SEQ ID NO: 8030 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
ctgtccaagcccggtt

SEQ ID NO: 8031 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
ctgtccaagcccggt

SEQ ID NO: 8032 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
ctgtccaagcccgg

SEQ ID NO: 8033 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
ctgtccaagcccg

SEQ ID NO: 8034 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
ctgtccaagccc

SEQ ID NO: 8035 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
ctgtccaagcc

SEQ ID NO: 8036 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
ctgtccaagc

SEQ ID NO: 8037 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
ctgtccaag

SEQ ID NO: 8038 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
ctgtccaa

SEQ ID NO: 8039 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
gttctgtccaagcccggttg

SEQ ID NO: 8040 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
gttctgtccaagcccggtt

SEQ ID NO: 8041 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
gttctgtccaagcccggt

SEQ ID NO: 8042 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
gttctgtccaagcccgg

SEQ ID NO: 8043 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
gttctgtccaagcccg

SEQ ID NO: 8044 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
gttctgtccaagccc

SEQ ID NO: 8045 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
gttctgtccaagcc

SEQ ID NO: 8046 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
gttctgtccaagc

SEQ ID NO: 8047 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
gttctgtccaag

SEQ ID NO: 8048 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
gttctgtccaa

SEQ ID NO: 8049 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
gttctgtcca

SEQ ID NO: 8050 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
gttctgtcc

SEQ ID NO: 8051 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
gttctgtc

SEQ ID NO: 8052 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
agttctgtccaagcccggtt

SEQ ID NO: 8053 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
agttctgtccaagcccggt

SEQ ID NO: 8054 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
agttctgtccaagcccgg

SEQ ID NO: 8055 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
agttctgtccaagcccg

SEQ ID NO: 8056 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
agttctgtccaagccc

SEQ ID NO: 8057 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
agttctgtccaagcc

SEQ ID NO: 8058 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
agttctgtccaagc

SEQ ID NO: 8059 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
agttctgtccaag

SEQ ID NO: 8060 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
agttctgtccaa

SEQ ID NO: 8061 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
agttctgtcca

SEQ ID NO: 8062 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
agttctgtcc

SEQ ID NO: 8063 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
agttctgtc

SEQ ID NO: 8064 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
agttctgt

SEQ ID NO: 8065 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
aagttctgtccaagcccggt

SEQ ID NO: 8066 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
aagttctgtccaagcccgg

SEQ ID NO: 8067 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
aagttctgtccaagcccg

SEQ ID NO: 8068 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
aagttctgtccaagccc

SEQ ID NO: 8069 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
aagttctgtccaagcc

SEQ ID NO: 8070 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
aagttctgtccaagc

SEQ ID NO: 8071 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
aagttctgtccaag

SEQ ID NO: 8072 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
aagttctgtccaa

SEQ ID NO: 8073 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
aagttctgtcca

SEQ ID NO: 8074 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
aagttctgtcc

SEQ ID NO: 8075 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
aagttctgtc

SEQ ID NO: 8076 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
aagttctgt

SEQ ID NO: 8077 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
aagttctg

SEQ ID NO: 8078 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
taagttctgtccaagcccgg

SEQ ID NO: 8079 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
taagttctgtccaagcccg

SEQ ID NO: 8080 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
taagttctgtccaagccc

SEQ ID NO: 8081 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
taagttctgtccaagcc

SEQ ID NO: 8082 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
taagttctgtccaagc

SEQ ID NO: 8083 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
taagttctgtccaa

SEQ ID NO: 8084 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
taagttctgtcca

SEQ ID NO: 8085 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
taagttctgtcc

SEQ ID NO: 8086 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
taagttctgtc

SEQ ID NO: 8087 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
taagttctgt

SEQ ID NO: 8088 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
taagttctg

SEQ ID NO: 8089 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
taagttct

SEQ ID NO: 8090 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
gtaagttctgtccaagcccg

SEQ ID NO: 8091 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
gtaagttctgtccaagccc

SEQ ID NO: 8092 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
gtaagttctgtccaagc

SEQ ID NO: 8093 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
gtaagttctgtccaag

SEQ ID NO: 8094 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
gtaagttctgtccaa

SEQ ID NO: 8095 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
gtaagttctgtcca

SEQ ID NO: 8096 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
gtaagttctgtcc

SEQ ID NO: 8097 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
gtaagttctgtc

SEQ ID NO: 8098 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
gtaagttctgt

SEQ ID NO: 8099 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
gtaagttctg

SEQ ID NO: 8100 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
gtaagttct

SEQ ID NO: 8101 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
gtaagttc

SEQ ID NO: 8102 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
ggtaagttctgtccaagccc

SEQ ID NO: 8103 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
ggtaagttctgtccaagcc

SEQ ID NO: 8104 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
ggtaagttctgtccaag

SEQ ID NO: 8105 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
ggtaagttctgtccaa

SEQ ID NO: 8106 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
ggtaagttctgtcca

SEQ ID NO: 8107 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
ggtaagttctgtcc

SEQ ID NO: 8108 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
ggtaagttctgtc

SEQ ID NO: 8109 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
ggtaagttctgt

SEQ ID NO: 8110 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
ggtaagttctg

SEQ ID NO: 8111 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
ggtaagttct

SEQ ID NO: 8112 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
ggtaagttc

SEQ ID NO: 8113 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
ggtaagtt

SEQ ID NO: 8114 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
cggtaagttctgtccaagcc

SEQ ID NO: 8115 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
cggtaagttctgtccaagc

SEQ ID NO: 8116 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
cggtaagttctgtccaag

SEQ ID NO: 8117 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
cggtaagttctgtccaa

SEQ ID NO: 8118 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
cggtaagttctgtcca

SEQ ID NO: 8119 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
cggtaagttctgtcc

SEQ ID NO: 8120 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
cggtaagttctgtc

SEQ ID NO: 8121 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
cggtaagttctgt

SEQ ID NO: 8122 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
cggtaagttctg

SEQ ID NO: 8123 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
cggtaagttct

SEQ ID NO: 8124 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
cggtaagttc

SEQ ID NO: 8125 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
cggtaagtt

SEQ ID NO: 8126 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
cggtaagt

SEQ ID NO: 8127 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
tcggtaagttctgtccaagc

SEQ ID NO: 8128 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
tcggtaagttctgtccaag

SEQ ID NO: 8129 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
tcggtaagttctgtccaa

SEQ ID NO: 8130 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
tcggtaagttctgtcca

SEQ ID NO: 8131 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
tcggtaagttctgtcc

SEQ ID NO: 8132 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
tcggtaagttctgtc

SEQ ID NO: 8133 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
tcggtaagttctgt

SEQ ID NO: 8134 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
tcggtaagttctg

SEQ ID NO: 8135 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
tcggtaagttct

SEQ ID NO: 8136 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
tcggtaagttc

SEQ ID NO: 8137 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
tcggtaagtt

SEQ ID NO: 8138 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
tcggtaagt

SEQ ID NO: 8139 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
gtcggtaagttctgtccaag

SEQ ID NO: 8140 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
gtcggtaagttctgtccaa

SEQ ID NO: 8141 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
gtcggtaagttctgtcca

SEQ ID NO: 8142 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
gtcggtaagttctgtcc

SEQ ID NO: 8143 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
gtcggtaagttctgtc

SEQ ID NO: 8144 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
gtcggtaagttctgt

SEQ ID NO: 8145 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
gtcggtaagttctg

SEQ ID NO: 8146 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
gtcggtaagttct

SEQ ID NO: 8147 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
gtcggtaagttc

SEQ ID NO: 8148 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
gtcggtaagtt

SEQ ID NO: 8149 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
gtcggtaagt

SEQ ID NO: 8150 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
agtcggtaagttctgtccaa

SEQ ID NO: 8151 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
agtcggtaagttctgtcca

SEQ ID NO: 8152 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
agtcggtaagttctgtc

SEQ ID NO: 8153 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
agtcggtaagttctgt

SEQ ID NO: 8154 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
agtcggtaagttctg

SEQ ID NO: 8155 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
agtcggtaagttct

SEQ ID NO: 8156 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
agtcggtaagttc

SEQ ID NO: 8157 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
agtcggtaagtt

SEQ ID NO: 8158 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
agtcggtaagt

SEQ ID NO: 8159 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
cagtcggtaagttctgtcca

SEQ ID NO: 8160 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
cagtcggtaagttctgtcc

SEQ ID NO: 8161 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
cagtcggtaagttctgtc

SEQ ID NO: 8162 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
cagtcggtaagttctgt

SEQ ID NO: 8163 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
cagtcggtaagttctg

SEQ ID NO: 8164 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
cagtcggtaagttct

SEQ ID NO: 8165 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
cagtcggtaagttc

SEQ ID NO: 8166 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
cagtcggtaagtt

SEQ ID NO: 8167 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
cagtcggtaagt

SEQ ID NO: 8168 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
ccagtcggtaagttctgtcc

SEQ ID NO: 8169 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
ccagtcggtaagttctgtc

SEQ ID NO: 8170 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
ccagtcggtaagttctgt

SEQ ID NO: 8171 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
ccagtcggtaagttctg

SEQ ID NO: 8172 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
ccagtcggtaagttct

SEQ ID NO: 8173 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
ccagtcggtaagttc

SEQ ID NO: 8174 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
ccagtcggtaagtt

SEQ ID NO: 8175 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
ccagtcggtaagt

SEQ ID NO: 8176 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
gccagtcggtaagttctgtc

SEQ ID NO: 8177 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
gccagtcggtaagttctgt

SEQ ID NO: 8178 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
gccagtcggtaagttctg

SEQ ID NO: 8179 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
gccagtcggtaagttct

SEQ ID NO: 8180 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
gccagtcggtaagttc

SEQ ID NO: 8181 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
gccagtcggtaagtt

SEQ ID NO: 8182 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
gccagtcggtaagt

SEQ ID NO: 8183 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
tcaaggaagatggcatttct

SEQ ID NO: 8184 - DNA, 22 bp, Artificial Sequence
  Description of Artificial Sequence: Synthetic Antisense oligonucleotide
  misc_feature (1)..(2): bicyclic nucleic acid (BNA)
  misc_feature (21)..(22): bicyclic nucleic acid (BNA)
tcaaggaagatggcatttctag

SEQ ID NO: 8185 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
tcaaggaagatggcat

SEQ ID NO: 8186 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
gaagatggcatttct

SEQ ID NO: 8187 - DNA, 21 bp, Artificial Sequence
  Description of Artificial Sequence: Synthetic Antisense oligonucleotide
  misc_feature (1)..(2): bicyclic nucleic acid (BNA)
  misc_feature (20)..(21): bicyclic nucleic acid (BNA)
tcaaggaagatggcatttcta

SEQ ID NO: 8188 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
tcaaggaagatggcatttc

SEQ ID NO: 8189 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
tcaaggaagatggcattt

SEQ ID NO: 8190 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
tcaaggaagatggcatt

SEQ ID NO: 8191 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
tcaaggaagatggca

SEQ ID NO: 8192 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
tcaaggaagatggc

SEQ ID NO: 8193 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
tcaaggaagatgg

SEQ ID NO: 8194 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
tcaaggaagatg

SEQ ID NO: 8195 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
tcaaggaagat

SEQ ID NO: 8196 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
tcaaggaaga

SEQ ID NO: 8197 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
tcaaggaag

SEQ ID NO: 8198 - DNA, 21 bp, Artificial Sequence
  Description of Artificial Sequence: Synthetic Antisense oligonucleotide
  misc_feature (1)..(2): bicyclic nucleic acid (BNA)
  misc_feature (20)..(21): bicyclic nucleic acid (BNA)
caaggaagatggcatttctag

SEQ ID NO: 8199 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
caaggaagatggcatttcta

SEQ ID NO: 8200 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
caaggaagatggcatttct

SEQ ID NO: 8201 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
caaggaagatggcatttc

SEQ ID NO: 8202 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
caaggaagatggcattt

SEQ ID NO: 8203 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
caaggaagatggcatt

SEQ ID NO: 8204 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
caaggaagatggcat

SEQ ID NO: 8205 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
caaggaagatggca

SEQ ID NO: 8206 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
caaggaagatggc

SEQ ID NO: 8207 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
caaggaagatgg

SEQ ID NO: 8208 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
caaggaagatg

SEQ ID NO: 8209 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
caaggaagat

SEQ ID NO: 8210 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
aaggaagatggcatttctag

SEQ ID NO: 8211 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
aaggaagatggcatttcta

SEQ ID NO: 8212 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
aaggaagatggcatttct

SEQ ID NO: 8213 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
aaggaagatggcatttc

SEQ ID NO: 8214 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
aaggaagatggcattt

SEQ ID NO: 8215 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
aaggaagatggcatt

SEQ ID NO: 8216 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
aaggaagatggcat

SEQ ID NO: 8217 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
aaggaagatggca

SEQ ID NO: 8218 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
aaggaagatggc

SEQ ID NO: 8219 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
aaggaagatgg

SEQ ID NO: 8220 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
aaggaagatg

SEQ ID NO: 8221 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
aaggaagat

SEQ ID NO: 8222 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
aggaagatggcatttctag

SEQ ID NO: 8223 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
aggaagatggcatttcta

SEQ ID NO: 8224 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
aggaagatggcatttct

SEQ ID NO: 8225 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
aggaagatggcatttc

SEQ ID NO: 8226 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
aggaagatggcattt

SEQ ID NO: 8227 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
aggaagatggcatt

SEQ ID NO: 8228 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
aggaagatggcat

SEQ ID NO: 8229 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
aggaagatggca

SEQ ID NO: 8230 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
aggaagatgg

SEQ ID NO: 8231 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
aggaagatg

SEQ ID NO: 8232 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
aggaagat

SEQ ID NO: 8233 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
ggaagatggcatttctag

SEQ ID NO: 8234 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
ggaagatggcatttcta

SEQ ID NO: 8235 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
ggaagatggcatttct

SEQ ID NO: 8236 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
ggaagatggcatttc

SEQ ID NO: 8237 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
ggaagatggcattt

SEQ ID NO: 8238 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
ggaagatggcatt

SEQ ID NO: 8239 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
ggaagatggcat

SEQ ID NO: 8240 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
ggaagatggca

SEQ ID NO: 8241 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
ggaagatggc

SEQ ID NO: 8242 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
ggaagatg

SEQ ID NO: 8243 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
gaagatggcatttctag

SEQ ID NO: 8244 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
gaagatggcatttcta

SEQ ID NO: 8245 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
gaagatggcatttc

SEQ ID NO: 8246 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
gaagatggcattt

SEQ ID NO: 8247 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
gaagatggcatt

SEQ ID NO: 8248 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
gaagatggcat

SEQ ID NO: 8249 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
gaagatggca

SEQ ID NO: 8250 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
gaagatggc

SEQ ID NO: 8251 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
gaagatgg

SEQ ID NO: 8252 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
aagatggcatttctag

SEQ ID NO: 8253 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
aagatggcatttcta

SEQ ID NO: 8254 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
aagatggcatttct

SEQ ID NO: 8255 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
aagatggcatttc

SEQ ID NO: 8256 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
aagatggcattt

SEQ ID NO: 8257 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
aagatggcatt

SEQ ID NO: 8258 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
aagatggcat

SEQ ID NO: 8259 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
aagatggca

SEQ ID NO: 8260 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
aagatggc

SEQ ID NO: 8261 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
agatggcatttctag

SEQ ID NO: 8262 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
agatggcatttcta

SEQ ID NO: 8263 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
agatggcatttct

SEQ ID NO: 8264 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
agatggcatttc

SEQ ID NO: 8265 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
agatggcattt

SEQ ID NO: 8266 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
agatggcatt

SEQ ID NO: 8267 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
agatggcat

SEQ ID NO: 8268 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
agatggca

SEQ ID NO: 8269 - DNA, 30 bp, Artificial Sequence; identical to SEQ ID NO: 8
  Description of Artificial Sequence: Synthetic Antisense oligonucleotide
  misc_feature (1)..(2): bicyclic nucleic acid (BNA)
  misc_feature (29)..(30): bicyclic nucleic acid (BNA)

SEQ ID NO: 8270 - DNA, 29 bp, Artificial Sequence
  Description of Artificial Sequence: Synthetic Antisense oligonucleotide
  misc_feature (1)..(2): bicyclic nucleic acid (BNA)
  misc_feature (28)..(29): bicyclic nucleic acid (BNA)
ctccaacatcaaggaagatggcatttcta

SEQ ID NO: 8271 - DNA, 28 bp, Artificial Sequence
  Description of Artificial Sequence: Synthetic Antisense oligonucleotide
  misc_feature (1)..(2): bicyclic nucleic acid (BNA)
  misc_feature (27)..(28): bicyclic nucleic acid (BNA)
ctccaacatcaaggaagatggcatttct

SEQ ID NO: 8272 - DNA, 27 bp, Artificial Sequence
  Description of Artificial Sequence: Synthetic Antisense oligonucleotide
  misc_feature (1)..(2): bicyclic nucleic acid (BNA)
  misc_feature (26)..(27): bicyclic nucleic acid (BNA)
ctccaacatcaaggaagatggcatttc

SEQ ID NO: 8273 - DNA, 26 bp, Artificial Sequence
  Description of Artificial Sequence: Synthetic Antisense oligonucleotide
  misc_feature (1)..(2): bicyclic nucleic acid (BNA)
  misc_feature (25)..(26): bicyclic nucleic acid (BNA)
ctccaacatcaaggaagatggcattt

SEQ ID NO: 8274 - DNA, 25 bp, Artificial Sequence
  Description of Artificial Sequence: Synthetic Antisense oligonucleotide
  misc_feature (1)..(2): bicyclic nucleic acid (BNA)
  misc_feature (24)..(25): bicyclic nucleic acid (BNA)
ctccaacatcaaggaagatggcatt

SEQ ID NO: 8275 - DNA, 24 bp, Artificial Sequence
  Description of Artificial Sequence: Synthetic Antisense oligonucleotide
  misc_feature (1)..(2): bicyclic nucleic acid (BNA)
  misc_feature (23)..(24): bicyclic nucleic acid (BNA)
ctccaacatcaaggaagatggcat

SEQ ID NO: 8276 - DNA, 23 bp, Artificial Sequence
  Description of Artificial Sequence: Synthetic Antisense oligonucleotide
  misc_feature (1)..(2): bicyclic nucleic acid (BNA)
  misc_feature (22)..(23): bicyclic nucleic acid (BNA)
ctccaacatcaaggaagatggca

SEQ ID NO: 8277 - DNA, 22 bp, Artificial Sequence
  Description of Artificial Sequence: Synthetic Antisense oligonucleotide
  misc_feature (1)..(2): bicyclic nucleic acid (BNA)
  misc_feature (21)..(22): bicyclic nucleic acid (BNA)
ctccaacatcaaggaagatggc

SEQ ID NO: 8278 - DNA, 21 bp, Artificial Sequence
  Description of Artificial Sequence: Synthetic Antisense oligonucleotide
  misc_feature (1)..(2): bicyclic nucleic acid (BNA)
  misc_feature (20)..(21): bicyclic nucleic acid (BNA)
ctccaacatcaaggaagatgg

SEQ ID NO: 8279 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
ctccaacatcaaggaagatg

SEQ ID NO: 8280 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
ctccaacatcaaggaagat

SEQ ID NO: 8281 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
ctccaacatcaaggaaga

SEQ ID NO: 8282 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
ctccaacatcaaggaag

SEQ ID NO: 8283 - DNA, 29 bp, Artificial Sequence
  Description of Artificial Sequence: Synthetic Antisense oligonucleotide
  misc_feature (1)..(2): bicyclic nucleic acid (BNA)
  misc_feature (28)..(29): bicyclic nucleic acid (BNA)
tccaacatcaaggaagatggcatttctag

SEQ ID NO: 8284 - DNA, 28 bp, Artificial Sequence
  Description of Artificial Sequence: Synthetic Antisense oligonucleotide
  misc_feature (1)..(2): bicyclic nucleic acid (BNA)
  misc_feature (27)..(28): bicyclic nucleic acid (BNA)
tccaacatcaaggaagatggcatttcta

SEQ ID NO: 8285 - DNA, 27 bp, Artificial Sequence
  Description of Artificial Sequence: Synthetic Antisense oligonucleotide
  misc_feature (1)..(2): bicyclic nucleic acid (BNA)
  misc_feature (26)..(27): bicyclic nucleic acid (BNA)
tccaacatcaaggaagatggcatttct

SEQ ID NO: 8286 - DNA, 26 bp, Artificial Sequence
  Description of Artificial Sequence: Synthetic Antisense oligonucleotide
  misc_feature (1)..(2): bicyclic nucleic acid (BNA)
  misc_feature (25)..(26): bicyclic nucleic acid (BNA)
tccaacatcaaggaagatggcatttc

SEQ ID NO: 8287 - DNA, 25 bp, Artificial Sequence
  Description of Artificial Sequence: Synthetic Antisense oligonucleotide
  misc_feature (1)..(2): bicyclic nucleic acid (BNA)
  misc_feature (24)..(25): bicyclic nucleic acid (BNA)
tccaacatcaaggaagatggcattt

SEQ ID NO: 8288 - DNA, 24 bp, Artificial Sequence
  Description of Artificial Sequence: Synthetic Antisense oligonucleotide
  misc_feature (1)..(2): bicyclic nucleic acid (BNA)
  misc_feature (23)..(24): bicyclic nucleic acid (BNA)
tccaacatcaaggaagatggcatt

SEQ ID NO: 8289 - DNA, 23 bp, Artificial Sequence
  Description of Artificial Sequence: Synthetic Antisense oligonucleotide
  misc_feature (1)..(2): bicyclic nucleic acid (BNA)
  misc_feature (22)..(23): bicyclic nucleic acid (BNA)
tccaacatcaaggaagatggcat

SEQ ID NO: 8290 - DNA, 22 bp, Artificial Sequence
  Description of Artificial Sequence: Synthetic Antisense oligonucleotide
  misc_feature (1)..(2): bicyclic nucleic acid (BNA)
  misc_feature (21)..(22): bicyclic nucleic acid (BNA)
tccaacatcaaggaagatggca

SEQ ID NO: 8291 - DNA, 21 bp, Artificial Sequence
  Description of Artificial Sequence: Synthetic Antisense oligonucleotide
  misc_feature (1)..(2): bicyclic nucleic acid (BNA)
  misc_feature (20)..(21): bicyclic nucleic acid (BNA)
tccaacatcaaggaagatggc

SEQ ID NO: 8292 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
tccaacatcaaggaagatgg

SEQ ID NO: 8293 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
tccaacatcaaggaagatg

SEQ ID NO: 8294 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
tccaacatcaaggaagat

SEQ ID NO: 8295 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
tccaacatcaaggaaga

SEQ ID NO: 8296 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
tccaacatcaaggaag

SEQ ID NO: 8297 - DNA, 28 bp, Artificial Sequence
  Description of Artificial Sequence: Synthetic Antisense oligonucleotide
  misc_feature (1)..(2): bicyclic nucleic acid (BNA)
  misc_feature (27)..(28): bicyclic nucleic acid (BNA)
ccaacatcaaggaagatggcatttctag

SEQ ID NO: 8298 - DNA, 27 bp, Artificial Sequence
  Description of Artificial Sequence: Synthetic Antisense oligonucleotide
  misc_feature (1)..(2): bicyclic nucleic acid (BNA)
  misc_feature (26)..(27): bicyclic nucleic acid (BNA)
ccaacatcaaggaagatggcatttcta

SEQ ID NO: 8299 - DNA, 26 bp, Artificial Sequence
  Description of Artificial Sequence: Synthetic Antisense oligonucleotide
  misc_feature (1)..(2): bicyclic nucleic acid (BNA)
  misc_feature (25)..(26): bicyclic nucleic acid (BNA)
ccaacatcaaggaagatggcatttct

SEQ ID NO: 8300 - DNA, 25 bp, Artificial Sequence
  Description of Artificial Sequence: Synthetic Antisense oligonucleotide
  misc_feature (1)..(2): bicyclic nucleic acid (BNA)
  misc_feature (24)..(25): bicyclic nucleic acid (BNA)
ccaacatcaaggaagatggcatttc

SEQ ID NO: 8301 - DNA, 24 bp, Artificial Sequence
  Description of Artificial Sequence: Synthetic Antisense oligonucleotide
  misc_feature (1)..(2): bicyclic nucleic acid (BNA)
  misc_feature (23)..(24): bicyclic nucleic acid (BNA)
ccaacatcaaggaagatggcattt

SEQ ID NO: 8302 - DNA, 23 bp, Artificial Sequence
  Description of Artificial Sequence: Synthetic Antisense oligonucleotide
  misc_feature (1)..(2): bicyclic nucleic acid (BNA)
  misc_feature (22)..(23): bicyclic nucleic acid (BNA)
ccaacatcaaggaagatggcatt

SEQ ID NO: 8303 - DNA, 22 bp, Artificial Sequence
  Description of Artificial Sequence: Synthetic Antisense oligonucleotide
  misc_feature (1)..(2): bicyclic nucleic acid (BNA)
  misc_feature (21)..(22): bicyclic nucleic acid (BNA)
ccaacatcaaggaagatggcat

SEQ ID NO: 8304 - DNA, 21 bp, Artificial Sequence
  Description of Artificial Sequence: Synthetic Antisense oligonucleotide
  misc_feature (1)..(2): bicyclic nucleic acid (BNA)
  misc_feature (20)..(21): bicyclic nucleic acid (BNA)
ccaacatcaaggaagatggca

SEQ ID NO: 8305 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
ccaacatcaaggaagatggc

SEQ ID NO: 8306 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
ccaacatcaaggaagatgg

SEQ ID NO: 8307 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
ccaacatcaaggaagatg

SEQ ID NO: 8308 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
ccaacatcaaggaagat

SEQ ID NO: 8309 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
ccaacatcaaggaaga

SEQ ID NO: 8310 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
ccaacatcaaggaag

SEQ ID NO: 8311 - DNA, 27 bp, Artificial Sequence
  Description of Artificial Sequence: Synthetic Antisense oligonucleotide
  misc_feature (1)..(2): bicyclic nucleic acid (BNA)
  misc_feature (26)..(27): bicyclic nucleic acid (BNA)
caacatcaaggaagatggcatttctag

SEQ ID NO: 8312 - DNA, 26 bp, Artificial Sequence
  Description of Artificial Sequence: Synthetic Antisense oligonucleotide
  misc_feature (1)..(2): bicyclic nucleic acid (BNA)
  misc_feature (25)..(26): bicyclic nucleic acid (BNA)
caacatcaaggaagatggcatttcta

SEQ ID NO: 8313 - DNA, 25 bp, Artificial Sequence
  Description of Artificial Sequence: Synthetic Antisense oligonucleotide
  misc_feature (1)..(2): bicyclic nucleic acid (BNA)
  misc_feature (24)..(25): bicyclic nucleic acid (BNA)
caacatcaaggaagatggcatttct

SEQ ID NO: 8314 - DNA, 24 bp, Artificial Sequence
  Description of Artificial Sequence: Synthetic Antisense oligonucleotide
  misc_feature (1)..(2): bicyclic nucleic acid (BNA)
  misc_feature (23)..(24): bicyclic nucleic acid (BNA)
caacatcaaggaagatggcatttc

SEQ ID NO: 8315 - DNA, 23 bp, Artificial Sequence
  Description of Artificial Sequence: Synthetic Antisense oligonucleotide
  misc_feature (1)..(2): bicyclic nucleic acid (BNA)
  misc_feature (22)..(23): bicyclic nucleic acid (BNA)
caacatcaaggaagatggcattt

SEQ ID NO: 8316 - DNA, 22 bp, Artificial Sequence
  Description of Artificial Sequence: Synthetic Antisense oligonucleotide
  misc_feature (1)..(2): bicyclic nucleic acid (BNA)
  misc_feature (21)..(22): bicyclic nucleic acid (BNA)
caacatcaaggaagatggcatt

SEQ ID NO: 8317 - DNA, 21 bp, Artificial Sequence
  Description of Artificial Sequence: Synthetic Antisense oligonucleotide
  misc_feature (1)..(2): bicyclic nucleic acid (BNA)
  misc_feature (20)..(21): bicyclic nucleic acid (BNA)
caacatcaaggaagatggcat

SEQ ID NO: 8318 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
caacatcaaggaagatggca

SEQ ID NO: 8319 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
caacatcaaggaagatggc

SEQ ID NO: 8320 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
caacatcaaggaagatgg

SEQ ID NO: 8321 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
caacatcaaggaagatg

SEQ ID NO: 8322 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
caacatcaaggaagat

SEQ ID NO: 8323 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
caacatcaaggaaga

SEQ ID NO: 8324 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
caacatcaaggaag

SEQ ID NO: 8325 - DNA, 26 bp, Artificial Sequence
  Description of Artificial Sequence: Synthetic Antisense oligonucleotide
  misc_feature (1)..(2): bicyclic nucleic acid (BNA)
  misc_feature (25)..(26): bicyclic nucleic acid (BNA)
aacatcaaggaagatggcatttctag

SEQ ID NO: 8326 - DNA, 25 bp, Artificial Sequence
  Description of Artificial Sequence: Synthetic Antisense oligonucleotide
  misc_feature (1)..(2): bicyclic nucleic acid (BNA)
  misc_feature (24)..(25): bicyclic nucleic acid (BNA)
aacatcaaggaagatggcatttcta

SEQ ID NO: 8327 - DNA, 24 bp, Artificial Sequence
  Description of Artificial Sequence: Synthetic Antisense oligonucleotide
  misc_feature (1)..(2): bicyclic nucleic acid (BNA)
  misc_feature (23)..(24): bicyclic nucleic acid (BNA)
aacatcaaggaagatggcatttct

SEQ ID NO: 8328 - DNA, 23 bp, Artificial Sequence
  Description of Artificial Sequence: Synthetic Antisense oligonucleotide
  misc_feature (1)..(2): bicyclic nucleic acid (BNA)
  misc_feature (22)..(23): bicyclic nucleic acid (BNA)
aacatcaaggaagatggcatttc

SEQ ID NO: 8329 - DNA, 22 bp, Artificial Sequence
  Description of Artificial Sequence: Synthetic Antisense oligonucleotide
  misc_feature (1)..(2): bicyclic nucleic acid (BNA)
  misc_feature (21)..(22): bicyclic nucleic acid (BNA)
aacatcaaggaagatggcattt

SEQ ID NO: 8330 - DNA, 21 bp, Artificial Sequence
  Description of Artificial Sequence: Synthetic Antisense oligonucleotide
  misc_feature (1)..(2): bicyclic nucleic acid (BNA)
  misc_feature (20)..(21): bicyclic nucleic acid (BNA)
aacatcaaggaagatggcatt

SEQ ID NO: 8331 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
aacatcaaggaagatggcat

SEQ ID NO: 8332 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
aacatcaaggaagatggca

SEQ ID NO: 8333 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
aacatcaaggaagatggc

SEQ ID NO: 8334 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
aacatcaaggaagatgg

SEQ ID NO: 8335 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
aacatcaaggaagatg

SEQ ID NO: 8336 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
aacatcaaggaagat

SEQ ID NO: 8337 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
aacatcaaggaaga

SEQ ID NO: 8338 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
aacatcaaggaag

SEQ ID NO: 8339 - DNA, 25 bp, Artificial Sequence
  Description of Artificial Sequence: Synthetic Antisense oligonucleotide
  misc_feature (1)..(2): bicyclic nucleic acid (BNA)
  misc_feature (24)..(25): bicyclic nucleic acid (BNA)
acatcaaggaagatggcatttctag

SEQ ID NO: 8340 - DNA, 24 bp, Artificial Sequence
  Description of Artificial Sequence: Synthetic Antisense oligonucleotide
  misc_feature (1)..(2): bicyclic nucleic acid (BNA)
  misc_feature (23)..(24): bicyclic nucleic acid (BNA)
acatcaaggaagatggcatttcta

SEQ ID NO: 8341 - DNA, 23 bp, Artificial Sequence
  Description of Artificial Sequence: Synthetic Antisense oligonucleotide
  misc_feature (1)..(2): bicyclic nucleic acid (BNA)
  misc_feature (22)..(23): bicyclic nucleic acid (BNA)
acatcaaggaagatggcatttct

SEQ ID NO: 8342 - DNA, 22 bp, Artificial Sequence
  Description of Artificial Sequence: Synthetic Antisense oligonucleotide
  misc_feature (1)..(2): bicyclic nucleic acid (BNA)
  misc_feature (21)..(22): bicyclic nucleic acid (BNA)
acatcaaggaagatggcatttc

SEQ ID NO: 8343 - DNA, 21 bp, Artificial Sequence
  Description of Artificial Sequence: Synthetic Antisense oligonucleotide
  misc_feature (1)..(2): bicyclic nucleic acid (BNA)
  misc_feature (20)..(21): bicyclic nucleic acid (BNA)
acatcaaggaagatggcattt

SEQ ID NO: 8344 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
acatcaaggaagatggcatt

SEQ ID NO: 8345 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
acatcaaggaagatggcat

SEQ ID NO: 8346 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
acatcaaggaagatggca

SEQ ID NO: 8347 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
acatcaaggaagatggc

SEQ ID NO: 8348 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
acatcaaggaagatgg

SEQ ID NO: 8349 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
acatcaaggaagatg

SEQ ID NO: 8350 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
acatcaaggaagat

SEQ ID NO: 8351 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
acatcaaggaaga

SEQ ID NO: 8352 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
acatcaaggaag

SEQ ID NO: 8353 - DNA, 24 bp, Artificial Sequence
  Description of Artificial Sequence: Synthetic Antisense oligonucleotide
  misc_feature (1)..(2): bicyclic nucleic acid (BNA)
  misc_feature (23)..(24): bicyclic nucleic acid (BNA)
catcaaggaagatggcatttctag

SEQ ID NO: 8354 - DNA, 23 bp, Artificial Sequence
  Description of Artificial Sequence: Synthetic Antisense oligonucleotide
  misc_feature (1)..(2): bicyclic nucleic acid (BNA)
  misc_feature (22)..(23): bicyclic nucleic acid (BNA)
catcaaggaagatggcatttcta

SEQ ID NO: 8355 - DNA, 22 bp, Artificial Sequence
  Description of Artificial Sequence: Synthetic Antisense oligonucleotide
  misc_feature (1)..(2): bicyclic nucleic acid (BNA)
  misc_feature (21)..(22): bicyclic nucleic acid (BNA)
catcaaggaagatggcatttct

SEQ ID NO: 8356 - DNA, 21 bp, Artificial Sequence
  Description of Artificial Sequence: Synthetic Antisense oligonucleotide
  misc_feature (1)..(2): bicyclic nucleic acid (BNA)
  misc_feature (20)..(21): bicyclic nucleic acid (BNA)
catcaaggaagatggcatttc

SEQ ID NO: 8357 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
catcaaggaagatggcattt

SEQ ID NO: 8358 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
catcaaggaagatggcatt

SEQ ID NO: 8359 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
catcaaggaagatggcat

SEQ ID NO: 8360 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
catcaaggaagatggca

SEQ ID NO: 8361 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
catcaaggaagatggc

SEQ ID NO: 8362 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
catcaaggaagatgg

SEQ ID NO: 8363 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
catcaaggaagatg

SEQ ID NO: 8364 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
catcaaggaagat

SEQ ID NO: 8365 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
catcaaggaaga

SEQ ID NO: 8366 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
catcaaggaag

SEQ ID NO: 8367 - DNA, 23 bp, Artificial Sequence
  Description of Artificial Sequence: Synthetic Antisense oligonucleotide
  misc_feature (1)..(2): bicyclic nucleic acid (BNA)
  misc_feature (22)..(23): bicyclic nucleic acid (BNA)
atcaaggaagatggcatttctag

SEQ ID NO: 8368 - DNA, 22 bp, Artificial Sequence
  Description of Artificial Sequence: Synthetic Antisense oligonucleotide
  misc_feature (1)..(2): bicyclic nucleic acid (BNA)
  misc_feature (21)..(22): bicyclic nucleic acid (BNA)
atcaaggaagatggcatttcta

SEQ ID NO: 8369 - DNA, 21 bp, Artificial Sequence
  Description of Artificial Sequence: Synthetic Antisense oligonucleotide
  misc_feature (1)..(2): bicyclic nucleic acid (BNA)
  misc_feature (20)..(21): bicyclic nucleic acid (BNA)
atcaaggaagatggcatttct

SEQ ID NO: 8370 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
atcaaggaagatggcatttc

SEQ ID NO: 8371 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
atcaaggaagatggcattt

SEQ ID NO: 8372 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
atcaaggaagatggcatt

SEQ ID NO: 8373 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
atcaaggaagatggcat

SEQ ID NO: 8374 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
atcaaggaagatggca

SEQ ID NO: 8375 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
atcaaggaagatggc

SEQ ID NO: 8376 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
atcaaggaagatgg

SEQ ID NO: 8377 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
atcaaggaagatg

SEQ ID NO: 8378 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
atcaaggaagat

SEQ ID NO: 8379 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
atcaaggaaga

SEQ ID NO: 8380 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
atcaaggaag

SEQ ID NO: 8381 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 8382 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 8383 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 8384 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
ctgtccaagcccggttga

SEQ ID NO: 8385 - DNA, 15 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (11)..(12): 5-methyl
taagttctgtccaag

SEQ ID NO: 8386 - DNA, 20 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(14): 5-methyl
ttctgtccaagcccggttga

SEQ ID NO: 8387 - DNA, 19 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(14): 5-methyl
ttctgtccaagcccggttg

SEQ ID NO: 8388 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(14): 5-methyl
ttctgtccaagcccggtt

SEQ ID NO: 8389 - DNA, 17 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(14): 5-methyl
ttctgtccaagcccggt

SEQ ID NO: 8390 - DNA, 16 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(14): 5-methyl
ttctgtccaagcccgg

SEQ ID NO: 8391 - DNA, 15 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(14): 5-methyl
ttctgtccaagcccg

SEQ ID NO: 8392 - DNA, 14 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(14): 5-methyl
ttctgtccaagccc

SEQ ID NO: 8393 - DNA, 13 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(13): 5-methyl
ttctgtccaagcc

SEQ ID NO: 8394 - DNA, 12 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (7)..(8): 5-methyl
  misc_feature (12)..(12): 5-methyl
ttctgtccaagc

SEQ ID NO: 8395 - DNA, 11 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (7)..(8): 5-methyl
ttctgtccaag

SEQ ID NO: 8396 - DNA, 10 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (7)..(8): 5-methyl
ttctgtccaa

SEQ ID NO: 8397 - DNA, 9 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (7)..(8): 5-methyl
ttctgtcca

SEQ ID NO: 8398 - DNA, 8 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (7)..(8): 5-methyl
ttctgtcc

SEQ ID NO: 8399 - DNA, 19 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(13): 5-methyl
tctgtccaagcccggttga

SEQ ID NO: 8400 - DNA, 18 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(13): 5-methyl
tctgtccaagcccggttg

SEQ ID NO: 8401 - DNA, 17 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(13): 5-methyl
tctgtccaagcccggtt

SEQ ID NO: 8402 - DNA, 16 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(13): 5-methyl
tctgtccaagcccggt

SEQ ID NO: 8403 - DNA, 15 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(13): 5-methyl
tctgtccaagcccgg

SEQ ID NO: 8404 - DNA, 14 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(13): 5-methyl
tctgtccaagcccg

SEQ ID NO: 8405 - DNA, 13 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(13): 5-methyl
tctgtccaagccc

SEQ ID NO: 8406 - DNA, 12 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(12): 5-methyl
tctgtccaagcc

SEQ ID NO: 8407 - DNA, 11 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (6)..(7): 5-methyl
  misc_feature (11)..(11): 5-methyl
tctgtccaagc

SEQ ID NO: 8408 - DNA, 10 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (6)..(7): 5-methyl
tctgtccaag

SEQ ID NO: 8409 - DNA, 9 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (6)..(7): 5-methyl
tctgtccaa

SEQ ID NO: 8410 - DNA, 8 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (6)..(7): 5-methyl
tctgtcca

SEQ ID NO: 8411 - DNA, 17 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
ctgtccaagcccggttg

SEQ ID NO: 8412 - DNA, 16 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
ctgtccaagcccggtt

SEQ ID NO: 8413 - DNA, 15 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
ctgtccaagcccggt

SEQ ID NO: 8414 - DNA, 14 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
ctgtccaagcccgg

SEQ ID NO: 8415 - DNA, 13 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
ctgtccaagcccg

SEQ ID NO: 8416 - DNA, 12 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
ctgtccaagccc

SEQ ID NO: 8417 - DNA, 11 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(11): 5-methyl
  misc_feature (1)..(1): bicyclic nucleic acid (BNA)
ctgtccaagcc

SEQ ID NO: 8418 - DNA, 10 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(10): 5-methyl
  misc_feature (1)..(1): bicyclic nucleic acid (BNA)
ctgtccaagc

SEQ ID NO: 8419 - DNA, 9 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (1)..(1): bicyclic nucleic acid (BNA)
ctgtccaag

SEQ ID NO: 8420 - DNA, 8 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (1)..(1): bicyclic nucleic acid (BNA)
ctgtccaa

SEQ ID NO: 8421 - DNA, 20 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
  misc_feature (13)..(15): 5-methyl
gttctgtccaagcccggttg

SEQ ID NO: 8422 - DNA, 19 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
  misc_feature (13)..(15): 5-methyl
gttctgtccaagcccggtt

SEQ ID NO: 8423 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
  misc_feature (13)..(15): 5-methyl
gttctgtccaagcccggt

SEQ ID NO: 8424 - DNA, 17 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
  misc_feature (13)..(15): 5-methyl
gttctgtccaagcccgg

SEQ ID NO: 8425 - DNA, 16 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
  misc_feature (13)..(15): 5-methyl
gttctgtccaagcccg

SEQ ID NO: 8426 - DNA, 15 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
  misc_feature (13)..(15): 5-methyl
gttctgtccaagccc

SEQ ID NO: 8427 - DNA, 14 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
  misc_feature (13)..(14): 5-methyl
gttctgtccaagcc

SEQ ID NO: 8428 - DNA, 13 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
  misc_feature (13)..(13): 5-methyl
gttctgtccaagc

SEQ ID NO: 8429 - DNA, 12 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
gttctgtccaag

SEQ ID NO: 8430 - DNA, 11 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
gttctgtccaa

SEQ ID NO: 8431 - DNA, 10 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
gttctgtcca

SEQ ID NO: 8432 - DNA, 9 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(9): 5-methyl
gttctgtcc

SEQ ID NO: 8433 - DNA, 8 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (8)..(8): 5-methyl
gttctgtc

SEQ ID NO: 8434 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
  misc_feature (14)..(16): 5-methyl
agttctgtccaagcccggtt

SEQ ID NO: 8435 - DNA, 19 bp, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
  misc_feature (14)..(16): 5-methyl
agttctgtccaagcccggt

SEQ ID NO: 8436 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
  misc_feature (14)..(16): 5-methyl
agttctgtccaagcccgg

SEQ ID NO: 8437 - DNA, 17 bp, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
  misc_feature (14)..(16): 5-methyl
agttctgtccaagcccg

SEQ ID NO: 8438 - DNA, 16 bp, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
  misc_feature (14)..(16): 5-methyl
agttctgtccaagccc

SEQ ID NO: 8439 - DNA, 15 bp, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
  misc_feature (14)..(15): 5-methyl
agttctgtccaagcc

SEQ ID NO: 8440 - DNA, 14 bp, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
  misc_feature (14)..(14): 5-methyl
agttctgtccaagc

SEQ ID NO: 8441 - DNA, 13 bp, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
agttctgtccaag

SEQ ID NO: 8442 - DNA, 12 bp, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
agttctgtccaa

SEQ ID NO: 8443 - DNA, 11 bp, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
agttctgtcca

SEQ ID NO: 8444 - DNA, 10 bp, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(10): 5-methyl
agttctgtcc

SEQ ID NO: 8445 - DNA, 9 bp, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
  misc_feature (9)..(9): 5-methyl
agttctgtc

SEQ ID NO: 8446 - DNA, 8 bp, Artificial Sequence
  Description of Artificial Sequence: Synthetic Antisense oligonucleotide
  misc_feature (1)..(1): bicyclic nucleic acid (BNA)
  misc_feature (5)..(5): 5-methyl
agttctgt

SEQ ID NO: 8447 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
  misc_feature (15)..(17): 5-methyl
aagttctgtccaagcccggt

SEQ ID NO: 8448 - DNA, 19 bp, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
  misc_feature (15)..(17): 5-methyl
aagttctgtccaagcccgg

SEQ ID NO: 8449 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
  misc_feature (15)..(17): 5-methyl
aagttctgtccaagcccg

SEQ ID NO: 8450 - DNA, 17 bp, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
  misc_feature (15)..(17): 5-methyl
aagttctgtccaagccc

SEQ ID NO: 8451 - DNA, 16 bp, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
  misc_feature (15)..(16): 5-methyl
aagttctgtccaagcc

SEQ ID NO: 8452 - DNA, 15 bp, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
  misc_feature (15)..(15): 5-methyl
aagttctgtccaagc

SEQ ID NO: 8453 - DNA, 14 bp, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
aagttctgtccaag

SEQ ID NO: 8454 - DNA, 13 bp, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
aagttctgtccaa

SEQ ID NO: 8455 - DNA, 12 bp, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
aagttctgtcca

SEQ ID NO: 8456 - DNA, 11 bp, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(11): 5-methyl
aagttctgtcc

SEQ ID NO: 8457 - DNA, 10 bp, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
  misc_feature (10)..(10): 5-methyl
aagttctgtc

SEQ ID NO: 8458 - DNA, 9 bp, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
aagttctgt

SEQ ID NO: 8459 - DNA, 8 bp, Artificial Sequence
  Description of Artificial Sequence: Synthetic Antisense oligonucleotide
  misc_feature (1)..(1): bicyclic nucleic acid (BNA)
  misc_feature (6)..(6): 5-methyl
aagttctg

SEQ ID NO: 8460 - DNA, 20 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (11)..(12): 5-methyl
  misc_feature (16)..(18): 5-methyl
taagttctgtccaagcccgg

SEQ ID NO: 8461 - DNA, 19 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (11)..(12): 5-methyl
  misc_feature (16)..(18): 5-methyl
taagttctgtccaagcccg

SEQ ID NO: 8462 - DNA, 18 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (11)..(12): 5-methyl
  misc_feature (16)..(18): 5-methyl
taagttctgtccaagccc

SEQ ID NO: 8463 - DNA, 17 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (11)..(12): 5-methyl
  misc_feature (16)..(17): 5-methyl
taagttctgtccaagcc

SEQ ID NO: 8464 - DNA, 16 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (11)..(12): 5-methyl
  misc_feature (16)..(16): 5-methyl
taagttctgtccaagc

SEQ ID NO: 8465 - DNA, 14 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (11)..(12): 5-methyl
taagttctgtccaa

SEQ ID NO: 8466 - DNA, 13 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (11)..(12): 5-methyl
taagttctgtcca

SEQ ID NO: 8467 - DNA, 12 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (11)..(12): 5-methyl
taagttctgtcc

SEQ ID NO: 8468 - DNA, 11 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (11)..(11): 5-methyl
taagttctgtc

SEQ ID NO: 8469 - DNA, 10 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
taagttctgt

SEQ ID NO: 8470 - DNA, 9 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
taagttctg

SEQ ID NO: 8471 - DNA, 8 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
taagttct

SEQ ID NO: 8472 - DNA, 20 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(13): 5-methyl
  misc_feature (17)..(19): 5-methyl
gtaagttctgtccaagcccg

SEQ ID NO: 8473 - DNA, 19 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(13): 5-methyl
  misc_feature (17)..(19): 5-methyl
gtaagttctgtccaagccc

SEQ ID NO: 8474 - DNA, 17 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(13): 5-methyl
  misc_feature (17)..(17): 5-methyl
gtaagttctgtccaagc

SEQ ID NO: 8475 - DNA, 16 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(13): 5-methyl
gtaagttctgtccaag

SEQ ID NO: 8476 - DNA, 15 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(13): 5-methyl
gtaagttctgtccaa

SEQ ID NO: 8477 - DNA, 14 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(13): 5-methyl
gtaagttctgtcca

SEQ ID NO: 8478 - DNA, 13 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(13): 5-methyl
gtaagttctgtcc

SEQ ID NO: 8479 - DNA, 12 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (12)..(12): 5-methyl
gtaagttctgtc

SEQ ID NO: 8480 - DNA, 11 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
gtaagttctgt

SEQ ID NO: 8481 - DNA, 10 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
gtaagttctg

SEQ ID NO: 8482 - DNA, 9 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
gtaagttct

SEQ ID NO: 8483 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
gtaagttc

SEQ ID NO: 8484 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (13)..(14): 5-methyl
  misc_feature (18)..(20): 5-methyl
ggtaagttctgtccaagccc

SEQ ID NO: 8485 - DNA, 19 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (13)..(14): 5-methyl
  misc_feature (18)..(19): 5-methyl
ggtaagttctgtccaagcc

SEQ ID NO: 8486 - DNA, 17 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (13)..(14): 5-methyl
ggtaagttctgtccaag

SEQ ID NO: 8487 - DNA, 16 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (13)..(14): 5-methyl
ggtaagttctgtccaa

SEQ ID NO: 8488 - DNA, 15 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (13)..(14): 5-methyl
ggtaagttctgtcca

SEQ ID NO: 8489 - DNA, 14 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (13)..(14): 5-methyl
ggtaagttctgtcc

SEQ ID NO: 8490 - DNA, 13 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (13)..(13): 5-methyl
ggtaagttctgtc

SEQ ID NO: 8491 - DNA, 12 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
ggtaagttctgt

SEQ ID NO: 8492 - DNA, 11 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
ggtaagttctg

SEQ ID NO: 8493 - DNA, 10 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
ggtaagttct

SEQ ID NO: 8494 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
ggtaagttc

SEQ ID NO: 8495 - DNA, 20 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(20): 5-methyl
  misc_feature (1)..(1): bicyclic nucleic acid (BNA)
cggtaagttctgtccaagcc

SEQ ID NO: 8496 - DNA, 19 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(19): 5-methyl
  misc_feature (1)..(1): bicyclic nucleic acid (BNA)
cggtaagttctgtccaagc

SEQ ID NO: 8497 - DNA, 18 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(1): bicyclic nucleic acid (BNA)
cggtaagttctgtccaag

SEQ ID NO: 8498 - DNA, 17 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(1): bicyclic nucleic acid (BNA)
cggtaagttctgtccaa

SEQ ID NO: 8499 - DNA, 16 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(1): bicyclic nucleic acid (BNA)
cggtaagttctgtcca

SEQ ID NO: 8500 - DNA, 15 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(1): bicyclic nucleic acid (BNA)
cggtaagttctgtcc

SEQ ID NO: 8501 - DNA, 14 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(14): 5-methyl
  misc_feature (1)..(1): bicyclic nucleic acid (BNA)
cggtaagttctgtc

SEQ ID NO: 8502 - DNA, 13 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(1): bicyclic nucleic acid (BNA)
cggtaagttctgt

SEQ ID NO: 8503 - DNA, 12 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(1): bicyclic nucleic acid (BNA)
cggtaagttctg

SEQ ID NO: 8504 - DNA, 11 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(1): bicyclic nucleic acid (BNA)
cggtaagttct

SEQ ID NO: 8505 - DNA, 10 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(1): bicyclic nucleic acid (BNA)
cggtaagttc

SEQ ID NO: 8506 - DNA, 9 bp, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
cggtaagtt

SEQ ID NO: 8507 - DNA, 8 bp, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
cggtaagt

SEQ ID NO: 8508 - DNA, 20 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (11)..(11): 5-methyl
  misc_feature (15)..(16): 5-methyl
  misc_feature (20)..(20): 5-methyl
tcggtaagttctgtccaagc

SEQ ID NO: 8509 - DNA, 19 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (11)..(11): 5-methyl
  misc_feature (15)..(16): 5-methyl
tcggtaagttctgtccaag

SEQ ID NO: 8510 - DNA, 18 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (11)..(11): 5-methyl
  misc_feature (15)..(16): 5-methyl
tcggtaagttctgtccaa

SEQ ID NO: 8511 - DNA, 17 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (11)..(11): 5-methyl
  misc_feature (15)..(16): 5-methyl
tcggtaagttctgtcca

SEQ ID NO: 8512 - DNA, 16 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (11)..(11): 5-methyl
  misc_feature (15)..(16): 5-methyl
tcggtaagttctgtcc

SEQ ID NO: 8513 - DNA, 15 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (11)..(11): 5-methyl
  misc_feature (15)..(15): 5-methyl
tcggtaagttctgtc

SEQ ID NO: 8514 - DNA, 14 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (11)..(11): 5-methyl
tcggtaagttctgt

SEQ ID NO: 8515 - DNA, 13 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (11)..(11): 5-methyl
tcggtaagttctg

SEQ ID NO: 8516 - DNA, 12 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (11)..(11): 5-methyl
tcggtaagttct

SEQ ID NO: 8517 - DNA, 11 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (11)..(11): 5-methyl
tcggtaagttc

SEQ ID NO: 8518 - DNA, 10 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
tcggtaagtt

SEQ ID NO: 8519 - DNA, 9 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
tcggtaagt

SEQ ID NO: 8520 - DNA, 20 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
  misc_feature (16)..(17): 5-methyl
gtcggtaagttctgtccaag

SEQ ID NO: 8521 - DNA, 19 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
  misc_feature (16)..(17): 5-methyl
gtcggtaagttctgtccaa

SEQ ID NO: 8522 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
  misc_feature (16)..(17): 5-methyl
gtcggtaagttctgtcca

SEQ ID NO: 8523 - DNA, 17 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
  misc_feature (16)..(17): 5-methyl
gtcggtaagttctgtcc

SEQ ID NO: 8524 - DNA, 16 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
  misc_feature (16)..(16): 5-methyl
gtcggtaagttctgtc

SEQ ID NO: 8525 - DNA, 15 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
gtcggtaagttctgt

SEQ ID NO: 8526 - DNA, 14 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
gtcggtaagttctg

SEQ ID NO: 8527 - DNA, 13 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
gtcggtaagttct

SEQ ID NO: 8528 - DNA, 12 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (12)..(12): 5-methyl
gtcggtaagttc

SEQ ID NO: 8529 - DNA, 11 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
gtcggtaagtt

SEQ ID NO: 8530 - DNA, 10 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
gtcggtaagt

SEQ ID NO: 8531 - DNA, 20 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (13)..(13): 5-methyl
  misc_feature (17)..(18): 5-methyl
agtcggtaagttctgtccaa

SEQ ID NO: 8532 - DNA, 19 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcca

SEQ ID NO: 8533 - DNA, 17 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (13)..(13): 5-methyl
  misc_feature (17)..(17): 5-methyl
agtcggtaagttctgtc

SEQ ID NO: 8534 - DNA, 16 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (13)..(13): 5-methyl
agtcggtaagttctgt

SEQ ID NO: 8535 - DNA, 15 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (13)..(13): 5-methyl
agtcggtaagttctg

SEQ ID NO: 8536 - DNA, 14 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (13)..(13): 5-methyl
agtcggtaagttct

SEQ ID NO: 8537 - DNA, 13 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
  misc_feature (13)..(13): 5-methyl
agtcggtaagttc

SEQ ID NO: 8538 - DNA, 12 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
agtcggtaagtt

SEQ ID NO: 8539 - DNA, 11 bp, Artificial Sequence
  Description of Artificial Sequence: Synthetic Antisense oligonucleotide
  misc_feature (1)..(1): bicyclic nucleic acid (BNA)
  misc_feature (4)..(4): 5-methyl
agtcggtaagt

SEQ ID NO: 8540 - DNA, 20 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (1)..(1): bicyclic nucleic acid (BNA)
cagtcggtaagttctgtcca

SEQ ID NO: 8541 - DNA, 19 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (1)..(1): bicyclic nucleic acid (BNA)
cagtcggtaagttctgtcc

SEQ ID NO: 8542 - DNA, 18 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(18): 5-methyl
  misc_feature (1)..(1): bicyclic nucleic acid (BNA)
cagtcggtaagttctgtc

SEQ ID NO: 8543 - DNA, 17 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(1): bicyclic nucleic acid (BNA)
cagtcggtaagttctgt

SEQ ID NO: 8544 - DNA, 16 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(1): bicyclic nucleic acid (BNA)
cagtcggtaagttctg

SEQ ID NO: 8545 - DNA, 15 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(1): bicyclic nucleic acid (BNA)
cagtcggtaagttct

SEQ ID NO: 8546 - DNA, 14 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(1): bicyclic nucleic acid (BNA)
cagtcggtaagttc

SEQ ID NO: 8547 - DNA, 13 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (1)..(1): bicyclic nucleic acid (BNA)
cagtcggtaagtt

SEQ ID NO: 8548 - DNA, 12 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (1)..(1): bicyclic nucleic acid (BNA)
cagtcggtaagt

SEQ ID NO: 8549 - DNA, 20 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(20): 5-methyl
  misc_feature (1)..(1): bicyclic nucleic acid (BNA)
ccagtcggtaagttctgtcc

SEQ ID NO: 8550 - DNA, 19 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(19): 5-methyl
  misc_feature (1)..(1): bicyclic nucleic acid (BNA)
ccagtcggtaagttctgtc

SEQ ID NO: 8551 - DNA, 18 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(1): bicyclic nucleic acid (BNA)
ccagtcggtaagttctgt

SEQ ID NO: 8552 - DNA, 17 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(1): bicyclic nucleic acid (BNA)
ccagtcggtaagttctg

SEQ ID NO: 8553 - DNA, 16 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(1): bicyclic nucleic acid (BNA)
ccagtcggtaagttct

SEQ ID NO: 8554 - DNA, 15 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(1): bicyclic nucleic acid (BNA)
ccagtcggtaagttc

SEQ ID NO: 8555 - DNA, 14 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (1)..(1): bicyclic nucleic acid (BNA)
ccagtcggtaagtt

SEQ ID NO: 8556 - DNA, 13 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (1)..(1): bicyclic nucleic acid (BNA)
ccagtcggtaagt

SEQ ID NO: 8557 - DNA, 20 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (7)..(7): 5-methyl
  misc_feature (16)..(16): 5-methyl
  misc_feature (20)..(20): 5-methyl
gccagtcggtaagttctgtc

SEQ ID NO: 8558 - DNA, 19 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (7)..(7): 5-methyl
  misc_feature (16)..(16): 5-methyl
gccagtcggtaagttctgt

SEQ ID NO: 8559 - DNA, 18 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (7)..(7): 5-methyl
  misc_feature (16)..(16): 5-methyl
gccagtcggtaagttctg

SEQ ID NO: 8560 - DNA, 17 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (7)..(7): 5-methyl
  misc_feature (16)..(16): 5-methyl
gccagtcggtaagttct

SEQ ID NO: 8561 - DNA, 16 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (7)..(7): 5-methyl
  misc_feature (16)..(16): 5-methyl
gccagtcggtaagttc

SEQ ID NO: 8562 - DNA, 15 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (7)..(7): 5-methyl
gccagtcggtaagtt

SEQ ID NO: 8563 - DNA, 14 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (7)..(7): 5-methyl
gccagtcggtaagt

SEQ ID NO: 8564 - DNA, 20 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 8565 - DNA, 22 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 8566 - DNA, 16 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (14)..(14): 5-methyl
tcaaggaagatggcat

SEQ ID NO: 8567 - DNA, 15 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (14)..(14): 5-methyl
gaagatggcatttct

SEQ ID NO: 8568 - DNA, 21 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttcta

SEQ ID NO: 8569 - DNA, 19 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttc

SEQ ID NO: 8570 - DNA, 18 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (14)..(14): 5-methyl
tcaaggaagatggcattt

SEQ ID NO: 8571 - DNA, 17 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (14)..(14): 5-methyl
tcaaggaagatggcatt

SEQ ID NO: 8572 - DNA, 15 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (14)..(14): 5-methyl
tcaaggaagatggca

SEQ ID NO: 8573 - DNA, 14 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (14)..(14): 5-methyl
tcaaggaagatggc

SEQ ID NO: 8574 - DNA, 13 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
tcaaggaagatgg

SEQ ID NO: 8575 - DNA, 12 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
tcaaggaagatg

SEQ ID NO: 8576 - DNA, 11 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
tcaaggaagat

SEQ ID NO: 8577 - DNA, 10 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
tcaaggaaga

SEQ ID NO: 8578 - DNA, 9 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
tcaaggaag

SEQ ID NO: 8579 - DNA, 21 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(1): bicyclic nucleic acid (BNA)
caaggaagatggcatttctag

SEQ ID NO: 8580 - DNA, 20 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(1): bicyclic nucleic acid (BNA)
caaggaagatggcatttcta

SEQ ID NO: 8581 - DNA, 19 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(1): bicyclic nucleic acid (BNA)
caaggaagatggcatttct

SEQ ID NO: 8582 - DNA, 18 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(1): bicyclic nucleic acid (BNA)
caaggaagatggcatttc

SEQ ID NO: 8583 - DNA, 17 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(1): bicyclic nucleic acid (BNA)
caaggaagatggcattt

SEQ ID NO: 8584 - DNA, 16 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(1): bicyclic nucleic acid (BNA)
caaggaagatggcatt

SEQ ID NO: 8585 - DNA, 15 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(1): bicyclic nucleic acid (BNA)
caaggaagatggcat

SEQ ID NO: 8586 - DNA, 14 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(1): bicyclic nucleic acid (BNA)
caaggaagatggca

SEQ ID NO: 8587 - DNA, 13 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(1): bicyclic nucleic acid (BNA)
caaggaagatggc

SEQ ID NO: 8588 - DNA, 12 bp, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
caaggaagatgg

SEQ ID NO: 8589 - DNA, 11 bp, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
caaggaagatg

SEQ ID NO: 8590 - DNA, 10 bp, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
caaggaagat

SEQ ID NO: 8591 - DNA, 20 bp, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
  misc_feature (17)..(17): 5-methyl
aaggaagatggcatttctag

SEQ ID NO: 8592 - DNA, 19 bp, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
  misc_feature (17)..(17): 5-methyl
aaggaagatggcatttcta

SEQ ID NO: 8593 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
  misc_feature (17)..(17): 5-methyl
aaggaagatggcatttct

SEQ ID NO: 8594 - DNA, 17 bp, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
  misc_feature (17)..(17): 5-methyl
aaggaagatggcatttc

SEQ ID NO: 8595 - DNA, 16 bp, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
aaggaagatggcattt

SEQ ID NO: 8596 - DNA, 15 bp, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
aaggaagatggcatt

SEQ ID NO: 8597 - DNA, 14 bp, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
aaggaagatggcat

SEQ ID NO: 8598 - DNA, 13 bp, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
aaggaagatggca

SEQ ID NO: 8599 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): 5-methyl
aaggaagatggc

SEQ ID NO: 8600 - DNA, 19 bp, Artificial Sequence
  Description of Artificial Sequence: Synthetic Antisense oligonucleotide
  misc_feature (1)..(1): bicyclic nucleic acid (BNA)
  misc_feature (11)..(11): 5-methyl
  misc_feature (16)..(16): 5-methyl
aggaagatggcatttctag

SEQ ID NO: 8601 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): 5-methyl
  misc_feature (16)..(16): 5-methyl
aggaagatggcatttcta

SEQ ID NO: 8602 - DNA, 17 bp, Artificial Sequence
  Description of Artificial Sequence: Synthetic Antisense oligonucleotide
  misc_feature (1)..(1): bicyclic nucleic acid (BNA)
  misc_feature (11)..(11): 5-methyl
  misc_feature (16)..(16): 5-methyl
aggaagatggcatttct

SEQ ID NO: 8603 - DNA, 16 bp, Artificial Sequence
  Description of Artificial Sequence: Synthetic Antisense oligonucleotide
  misc_feature (1)..(1): bicyclic nucleic acid (BNA)
  misc_feature (11)..(11): 5-methyl
  misc_feature (16)..(16): 5-methyl
aggaagatggcatttc

SEQ ID NO: 8604 - DNA, 15 bp, Artificial Sequence
  Description of Artificial Sequence: Synthetic Antisense oligonucleotide
  misc_feature (1)..(1): bicyclic nucleic acid (BNA)
  misc_feature (11)..(11): 5-methyl
aggaagatggcattt

SEQ ID NO: 8605 - DNA, 14 bp, Artificial Sequence
  Description of Artificial Sequence: Synthetic Antisense oligonucleotide
  misc_feature (1)..(1): bicyclic nucleic acid (BNA)
  misc_feature (11)..(11): 5-methyl
aggaagatggcatt

SEQ ID NO: 8606 - DNA, 13 bp, Artificial Sequence
  Description of Artificial Sequence: Synthetic Antisense oligonucleotide
  misc_feature (1)..(1): bicyclic nucleic acid (BNA)
  misc_feature (11)..(11): 5-methyl
aggaagatggcat

SEQ ID NO: 8607 - DNA, 12 bp, Artificial Sequence
  Description of Artificial Sequence: Synthetic Antisense oligonucleotide
  misc_feature (1)..(1): bicyclic nucleic acid (BNA)
  misc_feature (11)..(11): 5-methyl
aggaagatggca

SEQ ID NO: 8608 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
  misc_feature (15)..(15): 5-methyl
ggaagatggcatttctag

SEQ ID NO: 8609 - DNA, 17 bp, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
  misc_feature (15)..(15): 5-methyl
ggaagatggcatttcta

SEQ ID NO: 8610 - DNA, 16 bp, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
  misc_feature (15)..(15): 5-methyl
ggaagatggcatttct

SEQ ID NO: 8611 - DNA, 15 bp, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
  misc_feature (15)..(15): 5-methyl
ggaagatggcatttc

SEQ ID NO: 8612 - DNA, 14 bp, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
ggaagatggcattt

SEQ ID NO: 8613 - DNA, 13 bp, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
ggaagatggcatt

SEQ ID NO: 8614 - DNA, 12 bp, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
ggaagatggcat

SEQ ID NO: 8615 - DNA, 11 bp, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
ggaagatggca

SEQ ID NO: 8616 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): 5-methyl
ggaagatggc

SEQ ID NO: 8617 - DNA, 17 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (14)..(14): 5-methyl
gaagatggcatttctag

SEQ ID NO: 8618 - DNA, 16 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (14)..(14): 5-methyl
gaagatggcatttcta

SEQ ID NO: 8619 - DNA, 14 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
  misc_feature (14)..(14): 5-methyl
gaagatggcatttc

SEQ ID NO: 8620 - DNA, 13 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
gaagatggcattt

SEQ ID NO: 8621 - DNA, 12 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
gaagatggcatt

SEQ ID NO: 8622 - DNA, 11 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
gaagatggcat

SEQ ID NO: 8623 - DNA, 10 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
gaagatggca

SEQ ID NO: 8624 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): 5-methyl
gaagatggc

SEQ ID NO: 8625 - DNA, 16 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (13)..(13): 5-methyl
aagatggcatttctag

SEQ ID NO: 8626 - DNA, 15 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (13)..(13): 5-methyl
aagatggcatttcta

SEQ ID NO: 8627 - DNA, 14 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (13)..(13): 5-methyl
aagatggcatttct

SEQ ID NO: 8628 - DNA, 13 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
  misc_feature (13)..(13): 5-methyl
aagatggcatttc

SEQ ID NO: 8629 - DNA, 12 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
aagatggcattt

SEQ ID NO: 8630 - DNA, 11 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
aagatggcatt

SEQ ID NO: 8631 - DNA, 10 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
aagatggcat

SEQ ID NO: 8632 - DNA, 9 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
aagatggca

SEQ ID NO: 8633 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): 5-methyl
aagatggc

SEQ ID NO: 8634 - DNA, 15 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (12)..(12): 5-methyl
agatggcatttctag

SEQ ID NO: 8635 - DNA, 14 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (12)..(12): 5-methyl
agatggcatttcta

SEQ ID NO: 8636 - DNA, 13 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (12)..(12): 5-methyl
agatggcatttct

SEQ ID NO: 8637 - DNA, 12 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
  misc_feature (12)..(12): 5-methyl
agatggcatttc

SEQ ID NO: 8638 - DNA, 11 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
agatggcattt

SEQ ID NO: 8639 - DNA, 10 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
agatggcatt

SEQ ID NO: 8640 - DNA, 9 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
agatggcat

SEQ ID NO: 8641 - DNA, 8 bp, Artificial Sequence
  Description of Artificial Sequence: Synthetic Antisense oligonucleotide
  misc_feature (1)..(1): bicyclic nucleic acid (BNA)
  misc_feature (7)..(7): 5-methyl
agatggca

SEQ ID NO: 8642 - DNA, 30 bp, Artificial Sequence; identical to SEQ ID NO: 8
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(1): bicyclic nucleic acid (BNA)

SEQ ID NO: 8643 - DNA, 29 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(1): bicyclic nucleic acid (BNA)
ctccaacatcaaggaagatggcatttcta

SEQ ID NO: 8644 - DNA, 28 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(1): bicyclic nucleic acid (BNA)
ctccaacatcaaggaagatggcatttct

SEQ ID NO: 8645 - DNA, 27 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(1): bicyclic nucleic acid (BNA)
ctccaacatcaaggaagatggcatttc

SEQ ID NO: 8646 - DNA, 26 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
ctccaacatcaaggaagatggcattt

SEQ ID NO: 8647 - DNA, 25 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
ctccaacatcaaggaagatggcatt

SEQ ID NO: 8648 - DNA, 24 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
ctccaacatcaaggaagatggcat

SEQ ID NO: 8649 - DNA, 23 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
ctccaacatcaaggaagatggca

SEQ ID NO: 8650 - DNA, 22 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
ctccaacatcaaggaagatggc

SEQ ID NO: 8651 - DNA, 21 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
ctccaacatcaaggaagatgg

SEQ ID NO: 8652 - DNA, 20 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
ctccaacatcaaggaagatg

SEQ ID NO: 8653 - DNA, 19 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
ctccaacatcaaggaagat

SEQ ID NO: 8654 - DNA, 18 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
ctccaacatcaaggaaga

SEQ ID NO: 8655 - DNA, 17 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
ctccaacatcaaggaag

SEQ ID NO: 8656 - DNA, 29 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttctag

SEQ ID NO: 8657 - DNA, 28 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttcta

SEQ ID NO: 8658 - DNA, 27 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttct

SEQ ID NO: 8659 - DNA, 26 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttc

SEQ ID NO: 8660 - DNA, 25 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggcattt

SEQ ID NO: 8661 - DNA, 24 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggcatt

SEQ ID NO: 8662 - DNA, 23 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggcat

SEQ ID NO: 8663 - DNA, 22 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggca

SEQ ID NO: 8664 - DNA, 21 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggc

SEQ ID NO: 8665 - DNA, 20 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
tccaacatcaaggaagatgg

SEQ ID NO: 8666 - DNA, 19 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
tccaacatcaaggaagatg

SEQ ID NO: 8667 - DNA, 18 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
tccaacatcaaggaagat

SEQ ID NO: 8668 - DNA, 17 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
tccaacatcaaggaaga

SEQ ID NO: 8669 - DNA, 16 bp, Artificial Sequence
  Description of Artificial Sequence: Synthetic Antisense oligonucleotide
  misc_feature (1)..(1): bicyclic nucleic acid (BNA)
  misc_feature (2)..(3): 5-methyl
  misc_feature (6)..(6): 5-methyl
  misc_feature (9)..(9): 5-methyl
tccaacatcaaggaag

SEQ ID NO: 8670 - DNA, 28 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(1): bicyclic nucleic acid (BNA)
ccaacatcaaggaagatggcatttctag

SEQ ID NO: 8671 - DNA, 27 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(1): bicyclic nucleic acid (BNA)
ccaacatcaaggaagatggcatttcta

SEQ ID NO: 8672 - DNA, 26 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(1): bicyclic nucleic acid (BNA)
ccaacatcaaggaagatggcatttct

SEQ ID NO: 8673 - DNA, 25 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(1): bicyclic nucleic acid (BNA)
ccaacatcaaggaagatggcatttc

SEQ ID NO: 8674 - DNA, 24 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
ccaacatcaaggaagatggcattt

SEQ ID NO: 8675 - DNA, 23 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
ccaacatcaaggaagatggcatt

SEQ ID NO: 8676 - DNA, 22 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
ccaacatcaaggaagatggcat

SEQ ID NO: 8677 - DNA, 21 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
ccaacatcaaggaagatggca

SEQ ID NO: 8678 - DNA, 20 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
ccaacatcaaggaagatggc

SEQ ID NO: 8679 - DNA, 19 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
ccaacatcaaggaagatgg

SEQ ID NO: 8680 - DNA, 18 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
ccaacatcaaggaagatg

SEQ ID NO: 8681 - DNA, 17 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
ccaacatcaaggaagat

SEQ ID NO: 8682 - DNA, 16 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
ccaacatcaaggaaga

SEQ ID NO: 8683 - DNA, 15 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
ccaacatcaaggaag

SEQ ID NO: 8684 - DNA, 27 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(1): bicyclic nucleic acid (BNA)
caacatcaaggaagatggcatttctag

SEQ ID NO: 8685 - DNA, 26 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(1): bicyclic nucleic acid (BNA)
caacatcaaggaagatggcatttcta

SEQ ID NO: 8686 - DNA, 25 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(1): bicyclic nucleic acid (BNA)
caacatcaaggaagatggcatttct

SEQ ID NO: 8687 - DNA, 24 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(1): bicyclic nucleic acid (BNA)
caacatcaaggaagatggcatttc

SEQ ID NO: 8688 - DNA, 23 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
caacatcaaggaagatggcattt

SEQ ID NO: 8689 - DNA, 22 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
caacatcaaggaagatggcatt

SEQ ID NO: 8690 - DNA, 21 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
caacatcaaggaagatggcat

SEQ ID NO: 8691 - DNA, 20 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
caacatcaaggaagatggca

SEQ ID NO: 8692 - DNA, 19 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
caacatcaaggaagatggc

SEQ ID NO: 8693 - DNA, 18 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
caacatcaaggaagatgg

SEQ ID NO: 8694 - DNA, 17 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
caacatcaaggaagatg

SEQ ID NO: 8695 - DNA, 16 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
caacatcaaggaagat

SEQ ID NO: 8696 - DNA, 15 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
caacatcaaggaaga

SEQ ID NO: 8697 - DNA, 14 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
caacatcaaggaag

SEQ ID NO: 8698 - DNA, 26 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttctag

SEQ ID NO: 8699 - DNA, 25 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttcta

SEQ ID NO: 8700 - DNA, 24 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttct

SEQ ID NO: 8701 - DNA, 23 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttc

SEQ ID NO: 8702 - DNA, 22 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
aacatcaaggaagatggcattt

SEQ ID NO: 8703 - DNA, 21 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
aacatcaaggaagatggcatt

SEQ ID NO: 8704 - DNA, 20 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
aacatcaaggaagatggcat

SEQ ID NO: 8705 - DNA, 19 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
aacatcaaggaagatggca

SEQ ID NO: 8706 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
  misc_feature (18)..(18): 5-methyl
aacatcaaggaagatggc

SEQ ID NO: 8707 - DNA, 17 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
aacatcaaggaagatgg

SEQ ID NO: 8708 - DNA, 16 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
aacatcaaggaagatg

SEQ ID NO: 8709 - DNA, 15 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
aacatcaaggaagat

SEQ ID NO: 8710 - DNA, 14 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
aacatcaaggaaga

SEQ ID NO: 8711 - DNA, 13 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (6)..(6): 5-methyl
aacatcaaggaag

SEQ ID NO: 8712 - DNA, 25 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttctag

SEQ ID NO: 8713 - DNA, 24 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttcta

SEQ ID NO: 8714 - DNA, 23 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttct

SEQ ID NO: 8715 - DNA, 22 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttc

SEQ ID NO: 8716 - DNA, 21 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
acatcaaggaagatggcattt

SEQ ID NO: 8717 - DNA, 20 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
acatcaaggaagatggcatt

SEQ ID NO: 8718 - DNA, 19 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
acatcaaggaagatggcat

SEQ ID NO: 8719 - DNA, 18 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
acatcaaggaagatggca

SEQ ID NO: 8720 - DNA, 17 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
  misc_feature (17)..(17): 5-methyl
acatcaaggaagatggc

SEQ ID NO: 8721 - DNA, 16 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
acatcaaggaagatgg

SEQ ID NO: 8722 - DNA, 15 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
acatcaaggaagatg

SEQ ID NO: 8723 - DNA, 14 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
acatcaaggaagat

SEQ ID NO: 8724 - DNA, 13 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
acatcaaggaaga

SEQ ID NO: 8725 - DNA, 12 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (5)..(5): 5-methyl
acatcaaggaag

SEQ ID NO: 8726 - DNA, 24 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(1): bicyclic nucleic acid (BNA)
catcaaggaagatggcatttctag

SEQ ID NO: 8727 - DNA, 23 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(1): bicyclic nucleic acid (BNA)
catcaaggaagatggcatttcta

SEQ ID NO: 8728 - DNA, 22 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(1): bicyclic nucleic acid (BNA)
catcaaggaagatggcatttct

SEQ ID NO: 8729 - DNA, 21 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(1): bicyclic nucleic acid (BNA)
catcaaggaagatggcatttc

SEQ ID NO: 8730 - DNA, 20 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
catcaaggaagatggcattt

SEQ ID NO: 8731 - DNA, 19 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
catcaaggaagatggcatt

SEQ ID NO: 8732 - DNA, 18 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
catcaaggaagatggcat

SEQ ID NO: 8733 - DNA, 17 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
catcaaggaagatggca

SEQ ID NO: 8734 - DNA, 16 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
catcaaggaagatggc

SEQ ID NO: 8735 - DNA, 15 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
catcaaggaagatgg

SEQ ID NO: 8736 - DNA, 14 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
catcaaggaagatg

SEQ ID NO: 8737 - DNA, 13 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
catcaaggaagat

SEQ ID NO: 8738 - DNA, 12 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
catcaaggaaga

SEQ ID NO: 8739 - DNA, 11 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
catcaaggaag

SEQ ID NO: 8740 - DNA, 23 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
  misc_feature (20)..(20): 5-methyl
atcaaggaagatggcatttctag

SEQ ID NO: 8741 - DNA, 22 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
  misc_feature (20)..(20): 5-methyl
atcaaggaagatggcatttcta

SEQ ID NO: 8742 - DNA, 21 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
  misc_feature (20)..(20): 5-methyl
atcaaggaagatggcatttct

SEQ ID NO: 8743 - DNA, 20 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
  misc_feature (20)..(20): 5-methyl
atcaaggaagatggcatttc

SEQ ID NO: 8744 - DNA, 19 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
atcaaggaagatggcattt

SEQ ID NO: 8745 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
atcaaggaagatggcatt

SEQ ID NO: 8746 - DNA, 17 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
atcaaggaagatggcat

SEQ ID NO: 8747 - DNA, 16 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
atcaaggaagatggca

SEQ ID NO: 8748 - DNA, 15 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
  misc_feature (15)..(15): 5-methyl
atcaaggaagatggc

SEQ ID NO: 8749 - DNA, 14 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
atcaaggaagatgg

SEQ ID NO: 8750 - DNA, 13 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
atcaaggaagatg

SEQ ID NO: 8751 - DNA, 12 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
atcaaggaagat

SEQ ID NO: 8752 - DNA, 11 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
atcaaggaaga

SEQ ID NO: 8753 - DNA, 10 bp, Artificial Sequence
  Description of Artificial Sequence: Synthetic Antisense oligonucleotide
  misc_feature (1)..(1): bicyclic nucleic acid (BNA)
  misc_feature (3)..(3): 5-methyl
atcaaggaag

SEQ ID NO: 8754 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (18)..(18): bicyclic nucleic acid (BNA)
ggtaagttctgtccaagc

SEQ ID NO: 8755 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (18)..(18): bicyclic nucleic acid (BNA)
gtaagttctgtccaagcc

SEQ ID NO: 8756 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (18)..(18): bicyclic nucleic acid (BNA)
agtcggtaagttctgtcc

SEQ ID NO: 8757 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (18)..(18): bicyclic nucleic acid (BNA)
ctgtccaagcccggttga

SEQ ID NO: 8758 - DNA, 15 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (15)..(15): bicyclic nucleic acid (BNA)
taagttctgtccaag

SEQ ID NO: 8759 - DNA, 20 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (20)..(20): bicyclic nucleic acid (BNA)
ttctgtccaagcccggttga

SEQ ID NO: 8760 - DNA, 19 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (19)..(19): bicyclic nucleic acid (BNA)
ttctgtccaagcccggttg

SEQ ID NO: 8761 - DNA, 18 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (18)..(18): bicyclic nucleic acid (BNA)
ttctgtccaagcccggtt

SEQ ID NO: 8762 - DNA, 17 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (17)..(17): bicyclic nucleic acid (BNA)
ttctgtccaagcccggt

SEQ ID NO: 8763 - DNA, 16 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (16)..(16): bicyclic nucleic acid (BNA)
ttctgtccaagcccgg

SEQ ID NO: 8764 - DNA, 15 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (15)..(15): bicyclic nucleic acid (BNA)
ttctgtccaagcccg

SEQ ID NO: 8765 - DNA, 14 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (14)..(14): bicyclic nucleic acid (BNA)
ttctgtccaagccc

SEQ ID NO: 8766 - DNA, 13 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(13): 5-methyl
  misc_feature (13)..(13): bicyclic nucleic acid (BNA)
ttctgtccaagcc

SEQ ID NO: 8767 - DNA, 12 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(12): 5-methyl
  misc_feature (12)..(12): bicyclic nucleic acid (BNA)
ttctgtccaagc

SEQ ID NO: 8768 - DNA, 11 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (11)..(11): bicyclic nucleic acid (BNA)
ttctgtccaag

SEQ ID NO: 8769 - DNA, 10 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (10)..(10): bicyclic nucleic acid (BNA)
ttctgtccaa

SEQ ID NO: 8770 - DNA, 9 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (9)..(9): bicyclic nucleic acid (BNA)
ttctgtcca

SEQ ID NO: 8771 - DNA, 8 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (8)..(8): bicyclic nucleic acid (BNA)
ttctgtcc

SEQ ID NO: 8772 - DNA, 19 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (19)..(19): bicyclic nucleic acid (BNA)
tctgtccaagcccggttga

SEQ ID NO: 8773 - DNA, 18 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (18)..(18): bicyclic nucleic acid (BNA)
tctgtccaagcccggttg

SEQ ID NO: 8774 - DNA, 17 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (17)..(17): bicyclic nucleic acid (BNA)
tctgtccaagcccggtt

SEQ ID NO: 8775 - DNA, 16 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (16)..(16): bicyclic nucleic acid (BNA)
tctgtccaagcccggt

SEQ ID NO: 8776 - DNA, 15 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (15)..(15): bicyclic nucleic acid (BNA)
tctgtccaagcccgg

SEQ ID NO: 8777 - DNA, 14 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (14)..(14): bicyclic nucleic acid (BNA)
tctgtccaagcccg

SEQ ID NO: 8778 - DNA, 13 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (13)..(13): bicyclic nucleic acid (BNA)
tctgtccaagccc

SEQ ID NO: 8779 - DNA, 12 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(12): 5-methyl
  misc_feature (12)..(12): bicyclic nucleic acid (BNA)
tctgtccaagcc

SEQ ID NO: 8780 - DNA, 11 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(11): 5-methyl
  misc_feature (11)..(11): bicyclic nucleic acid (BNA)
tctgtccaagc

SEQ ID NO: 8781 - DNA, 10 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (10)..(10): bicyclic nucleic acid (BNA)
tctgtccaag

SEQ ID NO: 8782 - DNA, 9 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (9)..(9): bicyclic nucleic acid (BNA)
tctgtccaa

SEQ ID NO: 8783 - DNA, 8 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (8)..(8): bicyclic nucleic acid (BNA)
tctgtcca

SEQ ID NO: 8784 - DNA, 17 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (17)..(17): bicyclic nucleic acid (BNA)
ctgtccaagcccggttg

SEQ ID NO: 8785 - DNA, 16 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (16)..(16): bicyclic nucleic acid (BNA)
ctgtccaagcccggtt

SEQ ID NO: 8786 - DNA, 15 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (15)..(15): bicyclic nucleic acid (BNA)
ctgtccaagcccggt

SEQ ID NO: 8787 - DNA, 14 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (14)..(14): bicyclic nucleic acid (BNA)
ctgtccaagcccgg

SEQ ID NO: 8788 - DNA, 13 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(13): bicyclic nucleic acid (BNA)
ctgtccaagcccg

SEQ ID NO: 8789 - DNA, 12 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(12): bicyclic nucleic acid (BNA)
ctgtccaagccc

SEQ ID NO: 8790 - DNA, 11 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(11): 5-methyl
  misc_feature (11)..(11): bicyclic nucleic acid (BNA)
ctgtccaagcc

SEQ ID NO: 8791 - DNA, 10 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(10): 5-methyl
  misc_feature (10)..(10): bicyclic nucleic acid (BNA)
ctgtccaagc

SEQ ID NO: 8792 - DNA, 9 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (9)..(9): bicyclic nucleic acid (BNA)
ctgtccaag

SEQ ID NO: 8793 - DNA, 8 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (8)..(8): bicyclic nucleic acid (BNA)
ctgtccaa

SEQ ID NO: 8794 - DNA, 20 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (20)..(20): bicyclic nucleic acid (BNA)
gttctgtccaagcccggttg

SEQ ID NO: 8795 - DNA, 19 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (19)..(19): bicyclic nucleic acid (BNA)
gttctgtccaagcccggtt

SEQ ID NO: 8796 - DNA, 18 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (18)..(18): bicyclic nucleic acid (BNA)
gttctgtccaagcccggt

SEQ ID NO: 8797 - DNA, 17 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (17)..(17): bicyclic nucleic acid (BNA)
gttctgtccaagcccgg

SEQ ID NO: 8798 - DNA, 16 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (16)..(16): bicyclic nucleic acid (BNA)
gttctgtccaagcccg

SEQ ID NO: 8799 - DNA, 15 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (15)..(15): bicyclic nucleic acid (BNA)
gttctgtccaagccc

SEQ ID NO: 8800 - DNA, 14 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(14): 5-methyl
  misc_feature (14)..(14): bicyclic nucleic acid (BNA)
gttctgtccaagcc

SEQ ID NO: 8801 - DNA, 13 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(13): 5-methyl
  misc_feature (13)..(13): bicyclic nucleic acid (BNA)
gttctgtccaagc

SEQ ID NO: 8802 - DNA, 12 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (12)..(12): bicyclic nucleic acid (BNA)
gttctgtccaag

SEQ ID NO: 8803 - DNA, 11 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (11)..(11): bicyclic nucleic acid (BNA)
gttctgtccaa

SEQ ID NO: 8804 - DNA, 10 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (10)..(10): bicyclic nucleic acid (BNA)
gttctgtcca

SEQ ID NO: 8805 - DNA, 9 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (9)..(9): bicyclic nucleic acid (BNA)
gttctgtcc

SEQ ID NO: 8806 - DNA, 8 bp, Artificial Sequence
  Description of Artificial Sequence: Synthetic Antisense oligonucleotide
  misc_feature (4)..(4): 5-methyl
  misc_feature (8)..(8): 5-methyl
  misc_feature (8)..(8): bicyclic nucleic acid (BNA)
gttctgtc

SEQ ID NO: 8807 - DNA, 20 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
  misc_feature (20)..(20): bicyclic nucleic acid (BNA)
agttctgtccaagcccggtt

SEQ ID NO: 8808 - DNA, 19 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
  misc_feature (19)..(19): bicyclic nucleic acid (BNA)
agttctgtccaagcccggt

SEQ ID NO: 8809 - DNA, 18 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
  misc_feature (18)..(18): bicyclic nucleic acid (BNA)
agttctgtccaagcccgg

SEQ ID NO: 8810 - DNA, 17 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
  misc_feature (17)..(17): bicyclic nucleic acid (BNA)
agttctgtccaagcccg

SEQ ID NO: 8811 - DNA, 16 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
  misc_feature (16)..(16): bicyclic nucleic acid (BNA)
agttctgtccaagccc

SEQ ID NO: 8812 - DNA, 15 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(15): 5-methyl
  misc_feature (15)..(15): bicyclic nucleic acid (BNA)
agttctgtccaagcc

SEQ ID NO: 8813 - DNA, 14 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(14): 5-methyl
  misc_feature (14)..(14): bicyclic nucleic acid (BNA)
agttctgtccaagc

SEQ ID NO: 8814 - DNA, 13 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (13)..(13): bicyclic nucleic acid (BNA)
agttctgtccaag

SEQ ID NO: 8815 - DNA, 12 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (12)..(12): bicyclic nucleic acid (BNA)
agttctgtccaa

SEQ ID NO: 8816 - DNA, 11 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (11)..(11): bicyclic nucleic acid (BNA)
agttctgtcca

SEQ ID NO: 8817 - DNA, 10 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (10)..(10): bicyclic nucleic acid (BNA)
agttctgtcc

SEQ ID NO: 8818 - DNA, 9 bp, Artificial Sequence
  Description of Artificial Sequence: Synthetic Antisense oligonucleotide
  misc_feature (5)..(5): 5-methyl
  misc_feature (9)..(9): 5-methyl
  misc_feature (9)..(9): bicyclic nucleic acid (BNA)
agttctgtc

SEQ ID NO: 8819 - DNA, 8 bp, Artificial Sequence
  Description of Artificial Sequence: Synthetic Antisense oligonucleotide
  misc_feature (5)..(5): 5-methyl
  misc_feature (8)..(8): bicyclic nucleic acid (BNA)
agttctgt

SEQ ID NO: 8820 - DNA, 20 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
  misc_feature (20)..(20): bicyclic nucleic acid (BNA)
aagttctgtccaagcccggt

SEQ ID NO: 8821 - DNA, 19 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
  misc_feature (19)..(19): bicyclic nucleic acid (BNA)
aagttctgtccaagcccgg

SEQ ID NO: 8822 - DNA, 18 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
  misc_feature (18)..(18): bicyclic nucleic acid (BNA)
aagttctgtccaagcccg

SEQ ID NO: 8823 - DNA, 17 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
  misc_feature (17)..(17): bicyclic nucleic acid (BNA)
aagttctgtccaagccc

SEQ ID NO: 8824 - DNA, 16 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(16): 5-methyl
  misc_feature (16)..(16): bicyclic nucleic acid (BNA)
aagttctgtccaagcc

SEQ ID NO: 8825 - DNA, 15 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(15): 5-methyl
  misc_feature (15)..(15): bicyclic nucleic acid (BNA)
aagttctgtccaagc

SEQ ID NO: 8826 - DNA, 14 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (14)..(14): bicyclic nucleic acid (BNA)
aagttctgtccaag

SEQ ID NO: 8827 - DNA, 13 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (13)..(13): bicyclic nucleic acid (BNA)
aagttctgtccaa

SEQ ID NO: 8828 - DNA, 12 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (12)..(12): bicyclic nucleic acid (BNA)
aagttctgtcca

SEQ ID NO: 8829 - DNA, 11 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (11)..(11): bicyclic nucleic acid (BNA)
aagttctgtcc

SEQ ID NO: 8830 - DNA, 10 bp, Artificial Sequence
  Description of Artificial Sequence: Synthetic Antisense oligonucleotide
  misc_feature (6)..(6): 5-methyl
  misc_feature (10)..(10): 5-methyl
  misc_feature (10)..(10): bicyclic nucleic acid (BNA)
aagttctgtc

SEQ ID NO: 8831 - DNA, 9 bp, Artificial Sequence
  Description of Artificial Sequence: Synthetic Antisense oligonucleotide
  misc_feature (6)..(6): 5-methyl
  misc_feature (9)..(9): bicyclic nucleic acid (BNA)
aagttctgt

SEQ ID NO: 8832 - DNA, 8 bp, Artificial Sequence
  Description of Artificial Sequence: Synthetic Antisense oligonucleotide
  misc_feature (6)..(6): 5-methyl
  misc_feature (8)..(8): bicyclic nucleic acid (BNA)
aagttctg

SEQ ID NO: 8833 - DNA, 20 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
  misc_feature (20)..(20): bicyclic nucleic acid (BNA)
taagttctgtccaagcccgg

SEQ ID NO: 8834 - DNA, 19 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
  misc_feature (19)..(19): bicyclic nucleic acid (BNA)
taagttctgtccaagcccg

SEQ ID NO: 8835 - DNA, 18 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
  misc_feature (18)..(18): bicyclic nucleic acid (BNA)
taagttctgtccaagccc

SEQ ID NO: 8836 - DNA, 17 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(17): 5-methyl
  misc_feature (17)..(17): bicyclic nucleic acid (BNA)
taagttctgtccaagcc

SEQ ID NO: 8837 - DNA, 16 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(16): 5-methyl
  misc_feature (16)..(16): bicyclic nucleic acid (BNA)
taagttctgtccaagc

SEQ ID NO: 8838 - DNA, 14 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (14)..(14): bicyclic nucleic acid (BNA)
taagttctgtccaa

SEQ ID NO: 8839 - DNA, 13 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (13)..(13): bicyclic nucleic acid (BNA)
taagttctgtcca

SEQ ID NO: 8840 - DNA, 12 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (12)..(12): bicyclic nucleic acid (BNA)
taagttctgtcc

SEQ ID NO: 8841 - DNA, 11 bp, Artificial Sequence
  Description of Artificial Sequence: Synthetic Antisense oligonucleotide
  misc_feature (7)..(7): 5-methyl
  misc_feature (11)..(11): 5-methyl
  misc_feature (11)..(11): bicyclic nucleic acid (BNA)
taagttctgtc

SEQ ID NO: 8842 - DNA, 10 bp, Artificial Sequence
  Description of Artificial Sequence: Synthetic Antisense oligonucleotide
  misc_feature (7)..(7): 5-methyl
  misc_feature (10)..(10): bicyclic nucleic acid (BNA)
taagttctgt

SEQ ID NO: 8843 - DNA, 9 bp, Artificial Sequence
  Description of Artificial Sequence: Synthetic Antisense oligonucleotide
  misc_feature (7)..(7): 5-methyl
  misc_feature (9)..(9): bicyclic nucleic acid (BNA)
taagttctg

SEQ ID NO: 8844 - DNA, 8 bp, Artificial Sequence
  Description of Artificial Sequence: Synthetic Antisense oligonucleotide
  misc_feature (7)..(7): 5-methyl
  misc_feature (8)..(8): bicyclic nucleic acid (BNA)
taagttct

SEQ ID NO: 8845 - DNA, 20 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(19): 5-methyl
  misc_feature (20)..(20): bicyclic nucleic acid (BNA)
gtaagttctgtccaagcccg

SEQ ID NO: 8846 - DNA, 19 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(19): 5-methyl
  misc_feature (19)..(19): bicyclic nucleic acid (BNA)
gtaagttctgtccaagccc

SEQ ID NO: 8847 - DNA, 17 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(17): 5-methyl
  misc_feature (17)..(17): bicyclic nucleic acid (BNA)
gtaagttctgtccaagc

SEQ ID NO: 8848 - DNA, 16 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (16)..(16): bicyclic nucleic acid (BNA)
gtaagttctgtccaag

SEQ ID NO: 8849 - DNA, 15 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (15)..(15): bicyclic nucleic acid (BNA)
gtaagttctgtccaa

SEQ ID NO: 8850 - DNA, 14 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (14)..(14): bicyclic nucleic acid (BNA)
gtaagttctgtcca

SEQ ID NO: 8851 - DNA, 13 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (13)..(13): bicyclic nucleic acid (BNA)
gtaagttctgtcc

SEQ ID NO: 8852 - DNA, 12 bp, Artificial Sequence
  Description of Artificial Sequence: Synthetic Antisense oligonucleotide
  misc_feature (8)..(8): 5-methyl
  misc_feature (12)..(12): 5-methyl
  misc_feature (12)..(12): bicyclic nucleic acid (BNA)
gtaagttctgtc

SEQ ID NO: 8853 - DNA, 11 bp, Artificial Sequence
  Description of Artificial Sequence: Synthetic Antisense oligonucleotide
  misc_feature (8)..(8): 5-methyl
  misc_feature (11)..(11): bicyclic nucleic acid (BNA)
gtaagttctgt

SEQ ID NO: 8854 - DNA, 10 bp, Artificial Sequence
  Description of Artificial Sequence: Synthetic Antisense oligonucleotide
  misc_feature (8)..(8): 5-methyl
  misc_feature (10)..(10): bicyclic nucleic acid (BNA)
gtaagttctg

SEQ ID NO: 8855 - DNA, 9 bp, Artificial Sequence
  Description of Artificial Sequence: Synthetic Antisense oligonucleotide
  misc_feature (8)..(8): 5-methyl
  misc_feature (9)..(9): bicyclic nucleic acid (BNA)
gtaagttct

SEQ ID NO: 8856 - DNA, 8 bp, Artificial Sequence
  Description of Artificial Sequence: Synthetic Antisense oligonucleotide
  misc_feature (8)..(8): 5-methyl
  misc_feature (8)..(8): bicyclic nucleic acid (BNA)
gtaagttc

SEQ ID NO: 8857 - DNA, 20 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(20): 5-methyl
  misc_feature (20)..(20): bicyclic nucleic acid (BNA)
ggtaagttctgtccaagccc

SEQ ID NO: 8858 - DNA, 19 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(19): 5-methyl
  misc_feature (19)..(19): bicyclic nucleic acid (BNA)
ggtaagttctgtccaagcc

SEQ ID NO: 8859 - DNA, 17 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (17)..(17): bicyclic nucleic acid (BNA)
ggtaagttctgtccaag

SEQ ID NO: 8860 - DNA, 16 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (16)..(16): bicyclic nucleic acid (BNA)
ggtaagttctgtccaa

SEQ ID NO: 8861 - DNA, 15 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (15)..(15): bicyclic nucleic acid (BNA)
ggtaagttctgtcca

SEQ ID NO: 8862 - DNA, 14 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (14)..(14): bicyclic nucleic acid (BNA)
ggtaagttctgtcc

SEQ ID NO: 8863 - DNA, 13 bp, Artificial Sequence
  Description of Artificial Sequence: Synthetic Antisense oligonucleotide
  misc_feature (9)..(9): 5-methyl
  misc_feature (13)..(13): 5-methyl
  misc_feature (13)..(13): bicyclic nucleic acid (BNA)
ggtaagttctgtc

SEQ ID NO: 8864 - DNA, 12 bp, Artificial Sequence
  Description of Artificial Sequence: Synthetic Antisense oligonucleotide
  misc_feature (9)..(9): 5-methyl
  misc_feature (12)..(12): bicyclic nucleic acid (BNA)
ggtaagttctgt

SEQ ID NO: 8865 - DNA, 11 bp, Artificial Sequence
  Description of Artificial Sequence: Synthetic Antisense oligonucleotide
  misc_feature (9)..(9): 5-methyl
  misc_feature (11)..(11): bicyclic nucleic acid (BNA)
ggtaagttctg

SEQ ID NO: 8866 - DNA, 10 bp, Artificial Sequence
  Description of Artificial Sequence: Synthetic Antisense oligonucleotide
  misc_feature (9)..(9): 5-methyl
  misc_feature (10)..(10): bicyclic nucleic acid (BNA)
ggtaagttct

SEQ ID NO: 8867 - DNA, 9 bp, Artificial Sequence
  Description of Artificial Sequence: Synthetic Antisense oligonucleotide
  misc_feature (9)..(9): 5-methyl
  misc_feature (9)..(9): bicyclic nucleic acid (BNA)
ggtaagttc

SEQ ID NO: 8868 - DNA, 20 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(20): 5-methyl
  misc_feature (20)..(20): bicyclic nucleic acid (BNA)
cggtaagttctgtccaagcc

SEQ ID NO: 8869 - DNA, 19 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(19): 5-methyl
  misc_feature (19)..(19): bicyclic nucleic acid (BNA)
cggtaagttctgtccaagc

SEQ ID NO: 8870 - DNA, 18 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (18)..(18): bicyclic nucleic acid (BNA)
cggtaagttctgtccaag

SEQ ID NO: 8871 - DNA, 17 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (17)..(17): bicyclic nucleic acid (BNA)
cggtaagttctgtccaa

SEQ ID NO: 8872 - DNA, 16 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (16)..(16): bicyclic nucleic acid (BNA)
cggtaagttctgtcca

SEQ ID NO: 8873 - DNA, 15 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (15)..(15): bicyclic nucleic acid (BNA)
cggtaagttctgtcc

SEQ ID NO: 8874 - DNA, 14 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(14): 5-methyl
  misc_feature (14)..(14): bicyclic nucleic acid (BNA)
cggtaagttctgtc

SEQ ID NO: 8875 - DNA, 13 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (13)..(13): bicyclic nucleic acid (BNA)
cggtaagttctgt

SEQ ID NO: 8876 - DNA, 12 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (12)..(12): bicyclic nucleic acid (BNA)
cggtaagttctg

SEQ ID NO: 8877 - DNA, 11 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (11)..(11): bicyclic nucleic acid (BNA)
cggtaagttct

SEQ ID NO: 8878 - DNA, 10 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (10)..(10): bicyclic nucleic acid (BNA)
cggtaagttc

SEQ ID NO: 8879 - DNA, 9 bp, Artificial Sequence
  Description of Artificial Sequence: Synthetic Antisense oligonucleotide
  misc_feature (1)..(1): 5-methyl
  misc_feature (9)..(9): bicyclic nucleic acid (BNA)
cggtaagtt

SEQ ID NO: 8880 - DNA, 8 bp, Artificial Sequence
  Description of Artificial Sequence: Synthetic Antisense oligonucleotide
  misc_feature (1)..(1): 5-methyl
  misc_feature (8)..(8): bicyclic nucleic acid (BNA)
cggtaagt

SEQ ID NO: 8881 - DNA, 20 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (20)..(20): 5-methyl
  misc_feature (20)..(20): bicyclic nucleic acid (BNA)
tcggtaagttctgtccaagc

SEQ ID NO: 8882 - DNA, 19 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (19)..(19): bicyclic nucleic acid (BNA)
tcggtaagttctgtccaag

SEQ ID NO: 8883 - DNA, 18 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (18)..(18): bicyclic nucleic acid (BNA)
tcggtaagttctgtccaa

SEQ ID NO: 8884 - DNA, 17 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (17)..(17): bicyclic nucleic acid (BNA)
tcggtaagttctgtcca

SEQ ID NO: 8885 - DNA, 16 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (16)..(16): bicyclic nucleic acid (BNA)
tcggtaagttctgtcc

SEQ ID NO: 8886 - DNA, 15 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(15): 5-methyl
  misc_feature (15)..(15): bicyclic nucleic acid (BNA)
tcggtaagttctgtc

SEQ ID NO: 8887 - DNA, 14 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (14)..(14): bicyclic nucleic acid (BNA)
tcggtaagttctgt

SEQ ID NO: 8888 - DNA, 13 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (13)..(13): bicyclic nucleic acid (BNA)
tcggtaagttctg

SEQ ID NO: 8889 - DNA, 12 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (12)..(12): bicyclic nucleic acid (BNA)
tcggtaagttct

SEQ ID NO: 8890 - DNA, 11 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (11)..(11): bicyclic nucleic acid (BNA)
tcggtaagttc

SEQ ID NO: 8891 - DNA, 10 bp, Artificial Sequence
  Description of Artificial Sequence: Synthetic Antisense oligonucleotide
  misc_feature (2)..(2): 5-methyl
  misc_feature (10)..(10): bicyclic nucleic acid (BNA)
tcggtaagtt

SEQ ID NO: 8892 - DNA, 9 bp, Artificial Sequence
  Description of Artificial Sequence: Synthetic Antisense oligonucleotide
  misc_feature (2)..(2): 5-methyl
  misc_feature (9)..(9): bicyclic nucleic acid (BNA)
tcggtaagt

SEQ ID NO: 8893 - DNA, 20 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
  misc_feature (20)..(20): bicyclic nucleic acid (BNA)
gtcggtaagttctgtccaag

SEQ ID NO: 8894 - DNA, 19 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
  misc_feature (19)..(19): bicyclic nucleic acid (BNA)
gtcggtaagttctgtccaa

SEQ ID NO: 8895 - DNA, 18 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
  misc_feature (18)..(18): bicyclic nucleic acid (BNA)
gtcggtaagttctgtcca

SEQ ID NO: 8896 - DNA, 17 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
  misc_feature (17)..(17): bicyclic nucleic acid (BNA)
gtcggtaagttctgtcc

SEQ ID NO: 8897 - DNA, 16 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(16): 5-methyl
  misc_feature (16)..(16): bicyclic nucleic acid (BNA)
gtcggtaagttctgtc

SEQ ID NO: 8898 - DNA, 15 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (15)..(15): bicyclic nucleic acid (BNA)
gtcggtaagttctgt

SEQ ID NO: 8899 - DNA, 14 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (14)..(14): bicyclic nucleic acid (BNA)
gtcggtaagttctg

SEQ ID NO: 8900 - DNA, 13 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (13)..(13): bicyclic nucleic acid (BNA)
gtcggtaagttct

SEQ ID NO: 8901 - DNA, 12 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (12)..(12): bicyclic nucleic acid (BNA)
gtcggtaagttc

SEQ ID NO: 8902 - DNA, 11 bp, Artificial Sequence
  Description of Artificial Sequence: Synthetic Antisense oligonucleotide
  misc_feature (3)..(3): 5-methyl
  misc_feature (11)..(11): bicyclic nucleic acid (BNA)
gtcggtaagtt

SEQ ID NO: 8903 - DNA, 10 bp, Artificial Sequence
  Description of Artificial Sequence: Synthetic Antisense oligonucleotide
  misc_feature (3)..(3): 5-methyl
  misc_feature (10)..(10): bicyclic nucleic acid (BNA)
gtcggtaagt

SEQ ID NO: 8904 - DNA, 20 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (20)..(20): bicyclic nucleic acid (BNA)
agtcggtaagttctgtccaa

SEQ ID NO: 8905 - DNA, 19 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (19)..(19): bicyclic nucleic acid (BNA)
agtcggtaagttctgtcca

SEQ ID NO: 8906 - DNA, 17 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(17): 5-methyl
  misc_feature (17)..(17): bicyclic nucleic acid (BNA)
agtcggtaagttctgtc

SEQ ID NO: 8907 - DNA, 16 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (16)..(16): bicyclic nucleic acid (BNA)
agtcggtaagttctgt

SEQ ID NO: 8908 - DNA, 15 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (15)..(15): bicyclic nucleic acid (BNA)
agtcggtaagttctg

SEQ ID NO: 8909 - DNA, 14 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (14)..(14): bicyclic nucleic acid (BNA)
agtcggtaagttct

SEQ ID NO: 8910 - DNA, 13 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (13)..(13): bicyclic nucleic acid (BNA)
agtcggtaagttc

SEQ ID NO: 8911 - DNA, 12 bp, Artificial Sequence
  Description of Artificial Sequence: Synthetic Antisense oligonucleotide
  misc_feature (4)..(4): 5-methyl
  misc_feature (12)..(12): bicyclic nucleic acid (BNA)
agtcggtaagtt

SEQ ID NO: 8912 - DNA, 11 bp, Artificial Sequence
  Description of Artificial Sequence: Synthetic Antisense oligonucleotide
  misc_feature (4)..(4): 5-methyl
  misc_feature (11)..(11): bicyclic nucleic acid (BNA)
agtcggtaagt

SEQ ID NO: 8913 - DNA, 20 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (20)..(20): bicyclic nucleic acid (BNA)
cagtcggtaagttctgtcca

SEQ ID NO: 8914 - DNA, 19 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (19)..(19): bicyclic nucleic acid (BNA)
cagtcggtaagttctgtcc

SEQ ID NO: 8915 - DNA, 18 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(18): 5-methyl
  misc_feature (18)..(18): bicyclic nucleic acid (BNA)
cagtcggtaagttctgtc

SEQ ID NO: 8916 - DNA, 17 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (17)..(17): bicyclic nucleic acid (BNA)
cagtcggtaagttctgt

SEQ ID NO: 8917 - DNA, 16 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (16)..(16): bicyclic nucleic acid (BNA)
cagtcggtaagttctg

SEQ ID NO: 8918 - DNA, 15 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (15)..(15): bicyclic nucleic acid (BNA)
cagtcggtaagttct

SEQ ID NO: 8919 - DNA, 14 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (14)..(14): bicyclic nucleic acid (BNA)
cagtcggtaagttc

SEQ ID NO: 8920 - DNA, 13 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (13)..(13): bicyclic nucleic acid (BNA)
cagtcggtaagtt

SEQ ID NO: 8921 - DNA, 12 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (12)..(12): bicyclic nucleic acid (BNA)
cagtcggtaagt

SEQ ID NO: 8922 - DNA, 20 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(20): 5-methyl
  misc_feature (20)..(20): bicyclic nucleic acid (BNA)
ccagtcggtaagttctgtcc

SEQ ID NO: 8923 - DNA, 19 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(19): 5-methyl
  misc_feature (19)..(19): bicyclic nucleic acid (BNA)
ccagtcggtaagttctgtc

SEQ ID NO: 8924 - DNA, 18 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (18)..(18): bicyclic nucleic acid (BNA)
ccagtcggtaagttctgt

SEQ ID NO: 8925 - DNA, 17 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (17)..(17): bicyclic nucleic acid (BNA)
ccagtcggtaagttctg

SEQ ID NO: 8926 - DNA, 16 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (16)..(16): bicyclic nucleic acid (BNA)
ccagtcggtaagttct

SEQ ID NO: 8927 - DNA, 15 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (15)..(15): bicyclic nucleic acid (BNA)
ccagtcggtaagttc

SEQ ID NO: 8928 - DNA, 14 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (14)..(14): bicyclic nucleic acid (BNA)
ccagtcggtaagtt

SEQ ID NO: 8929 - DNA, 13 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (13)..(13): bicyclic nucleic acid (BNA)
ccagtcggtaagt

SEQ ID NO: 8930 - DNA, 20 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
  misc_feature (20)..(20): 5-methyl
  misc_feature (20)..(20): bicyclic nucleic acid (BNA)
gccagtcggtaagttctgtc

SEQ ID NO: 8931 - DNA, 19 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
  misc_feature (19)..(19): bicyclic nucleic acid (BNA)
gccagtcggtaagttctgt

SEQ ID NO: 8932 - DNA, 18 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
  misc_feature (18)..(18): bicyclic nucleic acid (BNA)
gccagtcggtaagttctg

SEQ ID NO: 8933 - DNA, 17 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
  misc_feature (17)..(17): bicyclic nucleic acid (BNA)
gccagtcggtaagttct

SEQ ID NO: 8934 - DNA, 16 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
  misc_feature (16)..(16): bicyclic nucleic acid (BNA)
gccagtcggtaagttc

SEQ ID NO: 8935 - DNA, 15 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (15)..(15): bicyclic nucleic acid (BNA)
gccagtcggtaagtt

SEQ ID NO: 8936 - DNA, 14 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (14)..(14): bicyclic nucleic acid (BNA)
gccagtcggtaagt

SEQ ID NO: 8937 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (20)..(20): bicyclic nucleic acid (BNA)
tcaaggaagatggcatttct

SEQ ID NO: 8938 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (22)..(22): bicyclic nucleic acid (BNA)
tcaaggaagatggcatttctag

SEQ ID NO: 8939 - DNA, 16 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (16)..(16): bicyclic nucleic acid (BNA)
tcaaggaagatggcat

SEQ ID NO: 8940 - DNA, 15 bp, Artificial Sequence
  Description of Artificial Sequence: Synthetic Antisense oligonucleotide
  misc_feature (9)..(9): 5-methyl
  misc_feature (14)..(14): 5-methyl
  misc_feature (15)..(15): bicyclic nucleic acid (BNA)
gaagatggcatttct

SEQ ID NO: 8941 - DNA, 21 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (21)..(21): bicyclic nucleic acid (BNA)
tcaaggaagatggcatttcta

SEQ ID NO: 8942 - DNA, 19 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (19)..(19): bicyclic nucleic acid (BNA)
tcaaggaagatggcatttc

SEQ ID NO: 8943 - DNA, 18 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (18)..(18): bicyclic nucleic acid (BNA)
tcaaggaagatggcattt

SEQ ID NO: 8944 - DNA, 17 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (17)..(17): bicyclic nucleic acid (BNA)
tcaaggaagatggcatt

SEQ ID NO: 8945 - DNA, 15 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (15)..(15): bicyclic nucleic acid (BNA)
tcaaggaagatggca

SEQ ID NO: 8946 - DNA, 14 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (14)..(14): bicyclic nucleic acid (BNA)
tcaaggaagatggc

SEQ ID NO: 8947 - DNA, 13 bp, Artificial Sequence
  Description of Artificial Sequence: Synthetic Antisense oligonucleotide
  misc_feature (2)..(2): 5-methyl
  misc_feature (13)..(13): bicyclic nucleic acid (BNA)
tcaaggaagatgg

SEQ ID NO: 8948 - DNA, 12 bp, Artificial Sequence
  Description of Artificial Sequence: Synthetic Antisense oligonucleotide
  misc_feature (2)..(2): 5-methyl
  misc_feature (12)..(12): bicyclic nucleic acid (BNA)
tcaaggaagatg

SEQ ID NO: 8949 - DNA, 11 bp, Artificial Sequence
  Description of Artificial Sequence: Synthetic Antisense oligonucleotide
  misc_feature (2)..(2): 5-methyl
  misc_feature (11)..(11): bicyclic nucleic acid (BNA)
tcaaggaagat

SEQ ID NO: 8950 - DNA, 10 bp, Artificial Sequence
  Description of Artificial Sequence: Synthetic Antisense oligonucleotide
  misc_feature (2)..(2): 5-methyl
  misc_feature (10)..(10): bicyclic nucleic acid (BNA)
tcaaggaaga

SEQ ID NO: 8951 - DNA, 9 bp, Artificial Sequence
  Description of Artificial Sequence: Synthetic Antisense oligonucleotide
  misc_feature (2)..(2): 5-methyl
  misc_feature (9)..(9): bicyclic nucleic acid (BNA)
tcaaggaag

SEQ ID NO: 8952 - DNA, 21 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (21)..(21): bicyclic nucleic acid (BNA)
caaggaagatggcatttctag

SEQ ID NO: 8953 - DNA, 20 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (20)..(20): bicyclic nucleic acid (BNA)
caaggaagatggcatttcta

SEQ ID NO: 8954 - DNA, 19 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (19)..(19): bicyclic nucleic acid (BNA)
caaggaagatggcatttct

SEQ ID NO: 8955 - DNA, 18 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (18)..(18): bicyclic nucleic acid (BNA)
caaggaagatggcatttc

SEQ ID NO: 8956 - DNA, 17 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (17)..(17): bicyclic nucleic acid (BNA)
caaggaagatggcattt

SEQ ID NO: 8957 - DNA, 16 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (16)..(16): bicyclic nucleic acid (BNA)
caaggaagatggcatt

SEQ ID NO: 8958 - DNA, 15 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (15)..(15): bicyclic nucleic acid (BNA)
caaggaagatggcat

SEQ ID NO: 8959 - DNA, 14 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (14)..(14): bicyclic nucleic acid (BNA)
caaggaagatggca

SEQ ID NO: 8960 - DNA, 13 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (13)..(13): bicyclic nucleic acid (BNA)
caaggaagatggc

SEQ ID NO: 8961 - DNA, 12 bp, Artificial Sequence
  Description of Artificial Sequence: Synthetic Antisense oligonucleotide
  misc_feature (1)..(1): 5-methyl
  misc_feature (12)..(12): bicyclic nucleic acid (BNA)
caaggaagatgg

SEQ ID NO: 8962 - DNA, 11 bp, Artificial Sequence
  Description of Artificial Sequence: Synthetic Antisense oligonucleotide
  misc_feature (1)..(1): 5-methyl
  misc_feature (11)..(11): bicyclic nucleic acid (BNA)
caaggaagatg

SEQ ID NO: 8963 - DNA, 10 bp, Artificial Sequence
  Description of Artificial Sequence: Synthetic Antisense oligonucleotide
  misc_feature (1)..(1): 5-methyl
  misc_feature (10)..(10): bicyclic nucleic acid (BNA)
caaggaagat

SEQ ID NO: 8964 - DNA, 20 bp, Artificial Sequence
  Description of Artificial Sequence: Synthetic Antisense oligonucleotide
  misc_feature (12)..(12): 5-methyl
  misc_feature (17)..(17): 5-methyl
  misc_feature (20)..(20): bicyclic nucleic acid (BNA)
aaggaagatggcatttctag

SEQ ID NO: 8965 - DNA, 19 bp, Artificial Sequence
  Description of Artificial Sequence: Synthetic Antisense oligonucleotide
  misc_feature (12)..(12): 5-methyl
  misc_feature (17)..(17): 5-methyl
  misc_feature (19)..(19): bicyclic nucleic acid (BNA)
aaggaagatggcatttcta

SEQ ID NO: 8966 - DNA, 18 bp, Artificial Sequence
  Description of Artificial Sequence: Synthetic Antisense oligonucleotide
  misc_feature (12)..(12): 5-methyl
  misc_feature (17)..(17): 5-methyl
  misc_feature (18)..(18): bicyclic nucleic acid (BNA)
aaggaagatggcatttct

SEQ ID NO: 8967 - DNA, 17 bp, Artificial Sequence
  Description of Artificial Sequence: Synthetic Antisense oligonucleotide
  misc_feature (12)..(12): 5-methyl
  misc_feature (17)..(17): 5-methyl
  misc_feature (17)..(17): bicyclic nucleic acid (BNA)
aaggaagatggcatttc

SEQ ID NO: 8968 - DNA, 16 bp, Artificial Sequence
  Description of Artificial Sequence: Synthetic Antisense oligonucleotide
  misc_feature (12)..(12): 5-methyl
  misc_feature (16)..(16): bicyclic nucleic acid (BNA)
aaggaagatggcattt

SEQ ID NO: 8969 - DNA, 15 bp, Artificial Sequence
  Description of Artificial Sequence: Synthetic Antisense oligonucleotide
  misc_feature (12)..(12): 5-methyl
  misc_feature (15)..(15): bicyclic nucleic acid (BNA)
aaggaagatggcatt

SEQ ID NO: 8970 - DNA, 14 bp, Artificial Sequence
  Description of Artificial Sequence: Synthetic Antisense oligonucleotide
  misc_feature (12)..(12): 5-methyl
  misc_feature (14)..(14): bicyclic nucleic acid (BNA)
aaggaagatggcat

SEQ ID NO: 8971 - DNA, 13 bp, Artificial Sequence
  Description of Artificial Sequence: Synthetic Antisense oligonucleotide
  misc_feature (12)..(12): 5-methyl
  misc_feature (13)..(13): bicyclic nucleic acid (BNA)
aaggaagatggca

SEQ ID NO: 8972 - DNA, 12 bp, Artificial Sequence
  Description of Artificial Sequence: Synthetic Antisense oligonucleotide
  misc_feature (12)..(12): 5-methyl
  misc_feature (12)..(12): bicyclic nucleic acid (BNA)
aaggaagatggc

SEQ ID NO: 8973 - DNA, 19 bp, Artificial Sequence
  Description of Artificial Sequence: Synthetic Antisense oligonucleotide
  misc_feature (11)..(11): 5-methyl
  misc_feature (16)..(16): 5-methyl
  misc_feature (19)..(19): bicyclic nucleic acid (BNA)
aggaagatggcatttctag

SEQ ID NO: 8974 - DNA, 18 bp, Artificial Sequence
  Description of Artificial Sequence: Synthetic Antisense oligonucleotide
  misc_feature (11)..(11): 5-methyl
  misc_feature (16)..(16): 5-methyl
  misc_feature (18)..(18): bicyclic nucleic acid (BNA)
aggaagatggcatttcta

SEQ ID NO: 8975 - DNA, 17 bp, Artificial Sequence
  Description of Artificial Sequence: Synthetic Antisense oligonucleotide
  misc_feature (11)..(11): 5-methyl
  misc_feature (16)..(16): 5-methyl
  misc_feature (17)..(17): bicyclic nucleic acid (BNA)
aggaagatggcatttct

SEQ ID NO: 8976 - DNA, 16 bp, Artificial Sequence
  Description of Artificial Sequence: Synthetic Antisense oligonucleotide
  misc_feature (11)..(11): 5-methyl
  misc_feature (16)..(16): 5-methyl
  misc_feature (16)..(16): bicyclic nucleic acid (BNA)
aggaagatggcatttc

SEQ ID NO: 8977 - DNA, 15 bp, Artificial Sequence
  Description of Artificial Sequence: Synthetic Antisense oligonucleotide
  misc_feature (11)..(11): 5-methyl
  misc_feature (15)..(15): bicyclic nucleic acid (BNA)
aggaagatggcattt

SEQ ID NO: 8978 - DNA, 14 bp, Artificial Sequence
  Description of Artificial Sequence: Synthetic Antisense oligonucleotide
  misc_feature (11)..(11): 5-methyl
  misc_feature (14)..(14): bicyclic nucleic acid (BNA)
aggaagatggcatt

SEQ ID NO: 8979 - DNA, 13 bp, Artificial Sequence
  Description of Artificial Sequence: Synthetic Antisense oligonucleotide
  misc_feature (11)..(11): 5-methyl
  misc_feature (13)..(13): bicyclic nucleic acid (BNA)
aggaagatggcat

SEQ ID NO: 8980 - DNA, 12 bp, Artificial Sequence
  Description of Artificial Sequence: Synthetic Antisense oligonucleotide
  misc_feature (11)..(11): 5-methyl
  misc_feature (12)..(12): bicyclic nucleic acid (BNA)
aggaagatggca

SEQ ID NO: 8981 - DNA, 18 bp, Artificial Sequence
  Description of Artificial Sequence: Synthetic Antisense oligonucleotide
  misc_feature (10)..(10): 5-methyl
  misc_feature (15)..(15): 5-methyl
  misc_feature (18)..(18): bicyclic nucleic acid (BNA)
ggaagatggcatttctag

SEQ ID NO: 8982 - DNA, 17 bp, Artificial Sequence
  Description of Artificial Sequence: Synthetic Antisense oligonucleotide
  misc_feature (10)..(10): 5-methyl
  misc_feature (15)..(15): 5-methyl
  misc_feature (17)..(17): bicyclic nucleic acid (BNA)
ggaagatggcatttcta

SEQ ID NO: 8983 - DNA, 16 bp, Artificial Sequence
  Description of Artificial Sequence: Synthetic Antisense oligonucleotide
  misc_feature (10)..(10): 5-methyl
  misc_feature (15)..(15): 5-methyl
  misc_feature (16)..(16): bicyclic nucleic acid (BNA)
ggaagatggcatttct

SEQ ID NO: 8984 - DNA, 15 bp, Artificial Sequence
  Description of Artificial Sequence: Synthetic Antisense oligonucleotide
  misc_feature (10)..(10): 5-methyl
  misc_feature (15)..(15): 5-methyl
  misc_feature (15)..(15): bicyclic nucleic acid (BNA)
ggaagatggcatttc

SEQ ID NO: 8985 - DNA, 14 bp, Artificial Sequence
  Description of Artificial Sequence: Synthetic Antisense oligonucleotide
  misc_feature (10)..(10): 5-methyl
  misc_feature (14)..(14): bicyclic nucleic acid (BNA)
ggaagatggcattt

SEQ ID NO: 8986 - DNA, 13 bp, Artificial Sequence
  Description of Artificial Sequence: Synthetic Antisense oligonucleotide
  misc_feature (10)..(10): 5-methyl
  misc_feature (13)..(13): bicyclic nucleic acid (BNA)
ggaagatggcatt

SEQ ID NO: 8987 - DNA, 12 bp, Artificial Sequence
  Description of Artificial Sequence: Synthetic Antisense oligonucleotide
  misc_feature (10)..(10): 5-methyl
  misc_feature (12)..(12): bicyclic nucleic acid (BNA)
ggaagatggcat

SEQ ID NO: 8988 - DNA, 11 bp, Artificial Sequence
  Description of Artificial Sequence: Synthetic Antisense oligonucleotide
  misc_feature (10)..(10): 5-methyl
  misc_feature (11)..(11): bicyclic nucleic acid (BNA)
ggaagatggca

SEQ ID NO: 8989 - DNA, 10 bp, Artificial Sequence
  Description of Artificial Sequence: Synthetic Antisense oligonucleotide
  misc_feature (10)..(10): 5-methyl
  misc_feature (10)..(10): bicyclic nucleic acid (BNA)
ggaagatggc

SEQ ID NO: 8990 - DNA, 17 bp, Artificial Sequence
  Description of Artificial Sequence: Synthetic Antisense oligonucleotide
  misc_feature (9)..(9): 5-methyl
  misc_feature (14)..(14): 5-methyl
  misc_feature (17)..(17): bicyclic nucleic acid (BNA)
gaagatggcatttctag

SEQ ID NO: 8991 - DNA, 16 bp, Artificial Sequence
  Description of Artificial Sequence: Synthetic Antisense oligonucleotide
  misc_feature (9)..(9): 5-methyl
  misc_feature (14)..(14): 5-methyl
  misc_feature (16)..(16): bicyclic nucleic acid (BNA)
gaagatggcatttcta

SEQ ID NO: 8992 - DNA, 14 bp, Artificial Sequence
  Description of Artificial Sequence: Synthetic Antisense oligonucleotide
  misc_feature (9)..(9): 5-methyl
  misc_feature (14)..(14): 5-methyl
  misc_feature (14)..(14): bicyclic nucleic acid (BNA)
gaagatggcatttc

SEQ ID NO: 8993 - DNA, 13 bp, Artificial Sequence
  Description of Artificial Sequence: Synthetic Antisense oligonucleotide
  misc_feature (9)..(9): 5-methyl
  misc_feature (13)..(13): bicyclic nucleic acid (BNA)
gaagatggcattt

SEQ ID NO: 8994 - DNA, 12 bp, Artificial Sequence
  Description of Artificial Sequence: Synthetic Antisense oligonucleotide
  misc_feature (9)..(9): 5-methyl
  misc_feature (12)..(12): bicyclic nucleic acid (BNA)
gaagatggcatt

SEQ ID NO: 8995 - DNA, 11 bp, Artificial Sequence
  Description of Artificial Sequence: Synthetic Antisense oligonucleotide
  misc_feature (9)..(9): 5-methyl
  misc_feature (11)..(11): bicyclic nucleic acid (BNA)
gaagatggcat

SEQ ID NO: 8996 - DNA, 10 bp, Artificial Sequence
  Description of Artificial Sequence: Synthetic Antisense oligonucleotide
  misc_feature (9)..(9): 5-methyl
  misc_feature (10)..(10): bicyclic nucleic acid (BNA)
gaagatggca

SEQ ID NO: 8997 - DNA, 9 bp, Artificial Sequence
  Description of Artificial Sequence: Synthetic Antisense oligonucleotide
  misc_feature (9)..(9): 5-methyl
  misc_feature (9)..(9): bicyclic nucleic acid (BNA)
gaagatggc

SEQ ID NO: 8998 - DNA, 16 bp, Artificial Sequence
  Description of Artificial Sequence: Synthetic Antisense oligonucleotide
  misc_feature (8)..(8): 5-methyl
  misc_feature (13)..(13): 5-methyl
  misc_feature (16)..(16): bicyclic nucleic acid (BNA)
aagatggcatttctag

SEQ ID NO: 8999 - DNA, 15 bp, Artificial Sequence
  Description of Artificial Sequence: Synthetic Antisense oligonucleotide
  misc_feature (8)..(8): 5-methyl
  misc_feature (13)..(13): 5-methyl
  misc_feature (15)..(15): bicyclic nucleic acid (BNA)
aagatggcatttcta

SEQ ID NO: 9000 - DNA, 14 bp, Artificial Sequence
  Description of Artificial Sequence: Synthetic Antisense oligonucleotide
  misc_feature (8)..(8): 5-methyl
  misc_feature (13)..(13): 5-methyl
  misc_feature (14)..(14): bicyclic nucleic acid (BNA)
aagatggcatttct

SEQ ID NO: 9001 - DNA, 13 bp, Artificial Sequence
  Description of Artificial Sequence: Synthetic Antisense oligonucleotide
  misc_feature (8)..(8): 5-methyl
  misc_feature (13)..(13): 5-methyl
  misc_feature (13)..(13): bicyclic nucleic acid (BNA)
aagatggcatttc

SEQ ID NO: 9002 - DNA, 12 bp, Artificial Sequence
  Description of Artificial Sequence: Synthetic Antisense oligonucleotide
  misc_feature (8)..(8): 5-methyl
  misc_feature (12)..(12): bicyclic nucleic acid (BNA)
aagatggcattt

SEQ ID NO: 9003 - DNA, 11 bp, Artificial Sequence
  Description of Artificial Sequence: Synthetic Antisense oligonucleotide
  misc_feature (8)..(8): 5-methyl
  misc_feature (11)..(11): bicyclic nucleic acid (BNA)
aagatggcatt

SEQ ID NO: 9004 - DNA, 10 bp, Artificial Sequence
  Description of Artificial Sequence: Synthetic Antisense oligonucleotide
  misc_feature (8)..(8): 5-methyl
  misc_feature (10)..(10): bicyclic nucleic acid (BNA)
aagatggcat

SEQ ID NO: 9005 - DNA, 9 bp, Artificial Sequence
  Description of Artificial Sequence: Synthetic Antisense oligonucleotide
  misc_feature (8)..(8): 5-methyl
  misc_feature (9)..(9): bicyclic nucleic acid (BNA)
aagatggca

SEQ ID NO: 9006 - DNA, 8 bp, Artificial Sequence
  Description of Artificial Sequence: Synthetic Antisense oligonucleotide
  misc_feature (8)..(8): 5-methyl
  misc_feature (8)..(8): bicyclic nucleic acid (BNA)
aagatggc

SEQ ID NO: 9007 - DNA, 15 bp, Artificial Sequence
  Description of Artificial Sequence: Synthetic Antisense oligonucleotide
  misc_feature (7)..(7): 5-methyl
  misc_feature (12)..(12): 5-methyl
  misc_feature (15)..(15): bicyclic nucleic acid (BNA)
agatggcatttctag

SEQ ID NO: 9008 - DNA, 14 bp, Artificial Sequence
  Description of Artificial Sequence: Synthetic Antisense oligonucleotide
  misc_feature (7)..(7): 5-methyl
  misc_feature (12)..(12): 5-methyl
  misc_feature (14)..(14): bicyclic nucleic acid (BNA)
agatggcatttcta

SEQ ID NO: 9009 - DNA, 13 bp, Artificial Sequence
  Description of Artificial Sequence: Synthetic Antisense oligonucleotide
  misc_feature (7)..(7): 5-methyl
  misc_feature (12)..(12): 5-methyl
  misc_feature (13)..(13): bicyclic nucleic acid (BNA)
agatggcatttct

SEQ ID NO: 9010 - DNA, 12 bp, Artificial Sequence
  Description of Artificial Sequence: Synthetic Antisense oligonucleotide
  misc_feature (7)..(7): 5-methyl
  misc_feature (12)..(12): 5-methyl
  misc_feature (12)..(12): bicyclic nucleic acid (BNA)
agatggcatttc

SEQ ID NO: 9011 - DNA, 11 bp, Artificial Sequence
  Description of Artificial Sequence: Synthetic Antisense oligonucleotide
  misc_feature (7)..(7): 5-methyl
  misc_feature (11)..(11): bicyclic nucleic acid (BNA)
agatggcattt

SEQ ID NO: 9012 - DNA, 10 bp, Artificial Sequence
  Description of Artificial Sequence: Synthetic Antisense oligonucleotide
  misc_feature (7)..(7): 5-methyl
  misc_feature (10)..(10): bicyclic nucleic acid (BNA)
agatggcatt

SEQ ID NO: 9013 - DNA, 9 bp, Artificial Sequence
  Description of Artificial Sequence: Synthetic Antisense oligonucleotide
  misc_feature (7)..(7): 5-methyl
  misc_feature (9)..(9): bicyclic nucleic acid (BNA)
agatggcat

SEQ ID NO: 9014 - DNA, 8 bp, Artificial Sequence
  Description of Artificial Sequence: Synthetic Antisense oligonucleotide
  misc_feature (7)..(7): 5-methyl
  misc_feature (8)..(8): bicyclic nucleic acid (BNA)
agatggca

SEQ ID NO: 9015 - DNA, 30 bp, Artificial Sequence; identical to SEQ ID NO: 8
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (30)..(30): bicyclic nucleic acid (BNA)

SEQ ID NO: 9016 - DNA, 29 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (29)..(29): bicyclic nucleic acid (BNA)
ctccaacatcaaggaagatggcatttcta

SEQ ID NO: 9017 - DNA, 28 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (28)..(28): bicyclic nucleic acid (BNA)
ctccaacatcaaggaagatggcatttct

SEQ ID NO: 9018 - DNA, 27 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (27)..(27): bicyclic nucleic acid (BNA)
ctccaacatcaaggaagatggcatttc

SEQ ID NO: 9019 - DNA, 26 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (26)..(26): bicyclic nucleic acid (BNA)
ctccaacatcaaggaagatggcattt

SEQ ID NO: 9020 - DNA, 25 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (25)..(25): bicyclic nucleic acid (BNA)
ctccaacatcaaggaagatggcatt

SEQ ID NO: 9021 - DNA, 24 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (24)..(24): bicyclic nucleic acid (BNA)
ctccaacatcaaggaagatggcat

SEQ ID NO: 9022 - DNA, 23 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (23)..(23): bicyclic nucleic acid (BNA)
ctccaacatcaaggaagatggca

SEQ ID NO: 9023 - DNA, 22 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (22)..(22): bicyclic nucleic acid (BNA)
ctccaacatcaaggaagatggc

SEQ ID NO: 9024 - DNA, 21 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (21)..(21): bicyclic nucleic acid (BNA)
ctccaacatcaaggaagatgg

SEQ ID NO: 9025 - DNA, 20 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (20)..(20): bicyclic nucleic acid (BNA)
ctccaacatcaaggaagatg

SEQ ID NO: 9026 - DNA, 19 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (19)..(19): bicyclic nucleic acid (BNA)
ctccaacatcaaggaagat

SEQ ID NO: 9027 - DNA, 18 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (18)..(18): bicyclic nucleic acid (BNA)
ctccaacatcaaggaaga

SEQ ID NO: 9028 - DNA, 17 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (17)..(17): bicyclic nucleic acid (BNA)
ctccaacatcaaggaag

SEQ ID NO: 9029 - DNA, 29 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
  misc_feature (29)..(29): bicyclic nucleic acid (BNA)
tccaacatcaaggaagatggcatttctag

SEQ ID NO: 9030 - DNA, 28 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
  misc_feature (28)..(28): bicyclic nucleic acid (BNA)
tccaacatcaaggaagatggcatttcta

SEQ ID NO: 9031 - DNA, 27 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
  misc_feature (27)..(27): bicyclic nucleic acid (BNA)
tccaacatcaaggaagatggcatttct

SEQ ID NO: 9032 - DNA, 26 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
  misc_feature (26)..(26): bicyclic nucleic acid (BNA)
tccaacatcaaggaagatggcatttc

SEQ ID NO: 9033 - DNA, 25 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (25)..(25): bicyclic nucleic acid (BNA)
tccaacatcaaggaagatggcattt

SEQ ID NO: 9034 - DNA, 24 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (24)..(24): bicyclic nucleic acid (BNA)
tccaacatcaaggaagatggcatt

SEQ ID NO: 9035 - DNA, 23 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (23)..(23): bicyclic nucleic acid (BNA)
tccaacatcaaggaagatggcat

SEQ ID NO: 9036 - DNA, 22 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (22)..(22): bicyclic nucleic acid (BNA)
tccaacatcaaggaagatggca

SEQ ID NO: 9037 - DNA, 21 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (21)..(21): bicyclic nucleic acid (BNA)
tccaacatcaaggaagatggc

SEQ ID NO: 9038 - DNA, 20 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (20)..(20): bicyclic nucleic acid (BNA)
tccaacatcaaggaagatgg

SEQ ID NO: 9039 - DNA, 19 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (19)..(19): bicyclic nucleic acid (BNA)
tccaacatcaaggaagatg

SEQ ID NO: 9040 - DNA, 18 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (18)..(18): bicyclic nucleic acid (BNA)
tccaacatcaaggaagat

SEQ ID NO: 9041 - DNA, 17 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (17)..(17): bicyclic nucleic acid (BNA)
tccaacatcaaggaaga

SEQ ID NO: 9042 - DNA, 16 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (16)..(16): bicyclic nucleic acid (BNA)
tccaacatcaaggaag

SEQ ID NO: 9043 - DNA, 28 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (28)..(28): bicyclic nucleic acid (BNA)
ccaacatcaaggaagatggcatttctag

SEQ ID NO: 9044 - DNA, 27 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (27)..(27): bicyclic nucleic acid (BNA)
ccaacatcaaggaagatggcatttcta

SEQ ID NO: 9045 - DNA, 26 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (26)..(26): bicyclic nucleic acid (BNA)
ccaacatcaaggaagatggcatttct

SEQ ID NO: 9046 - DNA, 25 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (25)..(25): bicyclic nucleic acid (BNA)
ccaacatcaaggaagatggcatttc

SEQ ID NO: 9047 - DNA, 24 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (24)..(24): bicyclic nucleic acid (BNA)
ccaacatcaaggaagatggcattt

SEQ ID NO: 9048 - DNA, 23 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (23)..(23): bicyclic nucleic acid (BNA)
ccaacatcaaggaagatggcatt

SEQ ID NO: 9049 - DNA, 22 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (22)..(22): bicyclic nucleic acid (BNA)
ccaacatcaaggaagatggcat

SEQ ID NO: 9050 - DNA, 21 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (21)..(21): bicyclic nucleic acid (BNA)
ccaacatcaaggaagatggca

SEQ ID NO: 9051 - DNA, 20 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (20)..(20): bicyclic nucleic acid (BNA)
ccaacatcaaggaagatggc

SEQ ID NO: 9052 - DNA, 19 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (19)..(19): bicyclic nucleic acid (BNA)
ccaacatcaaggaagatgg

SEQ ID NO: 9053 - DNA, 18 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (18)..(18): bicyclic nucleic acid (BNA)
ccaacatcaaggaagatg

SEQ ID NO: 9054 - DNA, 17 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (17)..(17): bicyclic nucleic acid (BNA)
ccaacatcaaggaagat

SEQ ID NO: 9055 - DNA, 16 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (16)..(16): bicyclic nucleic acid (BNA)
ccaacatcaaggaaga

SEQ ID NO: 9056 - DNA, 15 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (15)..(15): bicyclic nucleic acid (BNA)
ccaacatcaaggaag

SEQ ID NO: 9057 - DNA, 27 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (27)..(27): bicyclic nucleic acid (BNA)
caacatcaaggaagatggcatttctag

SEQ ID NO: 9058 - DNA, 26 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (26)..(26): bicyclic nucleic acid (BNA)
caacatcaaggaagatggcatttcta

SEQ ID NO: 9059 - DNA, 25 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (25)..(25): bicyclic nucleic acid (BNA)
caacatcaaggaagatggcatttct

SEQ ID NO: 9060 - DNA, 24 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (24)..(24): bicyclic nucleic acid (BNA)
caacatcaaggaagatggcatttc

SEQ ID NO: 9061 - DNA, 23 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (23)..(23): bicyclic nucleic acid (BNA)
caacatcaaggaagatggcattt

SEQ ID NO: 9062 - DNA, 22 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (22)..(22): bicyclic nucleic acid (BNA)
caacatcaaggaagatggcatt

SEQ ID NO: 9063 - DNA, 21 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (21)..(21): bicyclic nucleic acid (BNA)
caacatcaaggaagatggcat

SEQ ID NO: 9064 - DNA, 20 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (20)..(20): bicyclic nucleic acid (BNA)
caacatcaaggaagatggca

SEQ ID NO: 9065 - DNA, 19 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (19)..(19): bicyclic nucleic acid (BNA)
caacatcaaggaagatggc

SEQ ID NO: 9066 - DNA, 18 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (18)..(18): bicyclic nucleic acid (BNA)
caacatcaaggaagatgg

SEQ ID NO: 9067 - DNA, 17 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (17)..(17): bicyclic nucleic acid (BNA)
caacatcaaggaagatg

SEQ ID NO: 9068 - DNA, 16 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (16)..(16): bicyclic nucleic acid (BNA)
caacatcaaggaagat

SEQ ID NO: 9069 - DNA, 15 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (15)..(15): bicyclic nucleic acid (BNA)
caacatcaaggaaga

SEQ ID NO: 9070 - DNA, 14 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (14)..(14): bicyclic nucleic acid (BNA)
caacatcaaggaag

SEQ ID NO: 9071 - DNA, 26 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
  misc_feature (26)..(26): bicyclic nucleic acid (BNA)
aacatcaaggaagatggcatttctag

SEQ ID NO: 9072 - DNA, 25 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
  misc_feature (25)..(25): bicyclic nucleic acid (BNA)
aacatcaaggaagatggcatttcta

SEQ ID NO: 9073 - DNA, 24 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
  misc_feature (24)..(24): bicyclic nucleic acid (BNA)
aacatcaaggaagatggcatttct

SEQ ID NO: 9074 - DNA, 23 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
  misc_feature (23)..(23): bicyclic nucleic acid (BNA)
aacatcaaggaagatggcatttc

SEQ ID NO: 9075 - DNA, 22 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (22)..(22): bicyclic nucleic acid (BNA)
aacatcaaggaagatggcattt

SEQ ID NO: 9076 - DNA, 21 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (21)..(21): bicyclic nucleic acid (BNA)
aacatcaaggaagatggcatt

SEQ ID NO: 9077 - DNA, 20 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (20)..(20): bicyclic nucleic acid (BNA)
aacatcaaggaagatggcat

SEQ ID NO: 9078 - DNA, 19 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (19)..(19): bicyclic nucleic acid (BNA)
aacatcaaggaagatggca

SEQ ID NO: 9079 - DNA, 18 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (18)..(18): bicyclic nucleic acid (BNA)
aacatcaaggaagatggc

SEQ ID NO: 9080 - DNA, 17 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (17)..(17): bicyclic nucleic acid (BNA)
aacatcaaggaagatgg

SEQ ID NO: 9081 - DNA, 16 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (16)..(16): bicyclic nucleic acid (BNA)
aacatcaaggaagatg

SEQ ID NO: 9082 - DNA, 15 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (15)..(15): bicyclic nucleic acid (BNA)
aacatcaaggaagat

SEQ ID NO: 9083 - DNA, 14 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (14)..(14): bicyclic nucleic acid (BNA)
aacatcaaggaaga

SEQ ID NO: 9084 - DNA, 13 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (13)..(13): bicyclic nucleic acid (BNA)
aacatcaaggaag

SEQ ID NO: 9085 - DNA, 25 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
  misc_feature (25)..(25): bicyclic nucleic acid (BNA)
acatcaaggaagatggcatttctag

SEQ ID NO: 9086 - DNA, 24 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
  misc_feature (24)..(24): bicyclic nucleic acid (BNA)
acatcaaggaagatggcatttcta

SEQ ID NO: 9087 - DNA, 23 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
  misc_feature (23)..(23): bicyclic nucleic acid (BNA)
acatcaaggaagatggcatttct

SEQ ID NO: 9088 - DNA, 22 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
  misc_feature (22)..(22): bicyclic nucleic acid (BNA)
acatcaaggaagatggcatttc

SEQ ID NO: 9089 - DNA, 21 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (21)..(21): bicyclic nucleic acid (BNA)
acatcaaggaagatggcattt

SEQ ID NO: 9090 - DNA, 20 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (20)..(20): bicyclic nucleic acid (BNA)
acatcaaggaagatggcatt

SEQ ID NO: 9091 - DNA, 19 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (19)..(19): bicyclic nucleic acid (BNA)
acatcaaggaagatggcat

SEQ ID NO: 9092 - DNA, 18 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (18)..(18): bicyclic nucleic acid (BNA)
acatcaaggaagatggca

SEQ ID NO: 9093 - DNA, 17 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (17)..(17): bicyclic nucleic acid (BNA)
acatcaaggaagatggc

SEQ ID NO: 9094 - DNA, 16 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (16)..(16): bicyclic nucleic acid (BNA)
acatcaaggaagatgg

SEQ ID NO: 9095 - DNA, 15 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (15)..(15): bicyclic nucleic acid (BNA)
acatcaaggaagatg

SEQ ID NO: 9096 - DNA, 14 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (14)..(14): bicyclic nucleic acid (BNA)
acatcaaggaagat

SEQ ID NO: 9097 - DNA, 13 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (13)..(13): bicyclic nucleic acid (BNA)
acatcaaggaaga

SEQ ID NO: 9098 - DNA, 12 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (12)..(12): bicyclic nucleic acid (BNA)
acatcaaggaag

SEQ ID NO: 9099 - DNA, 24 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (24)..(24): bicyclic nucleic acid (BNA)
catcaaggaagatggcatttctag

SEQ ID NO: 9100 - DNA, 23 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (23)..(23): bicyclic nucleic acid (BNA)
catcaaggaagatggcatttcta

SEQ ID NO: 9101 - DNA, 22 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (22)..(22): bicyclic nucleic acid (BNA)
catcaaggaagatggcatttct

SEQ ID NO: 9102 - DNA, 21 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (21)..(21): bicyclic nucleic acid (BNA)
catcaaggaagatggcatttc

SEQ ID NO: 9103 - DNA, 20 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (20)..(20): bicyclic nucleic acid (BNA)
catcaaggaagatggcattt

SEQ ID NO: 9104 - DNA, 19 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (19)..(19): bicyclic nucleic acid (BNA)
catcaaggaagatggcatt

SEQ ID NO: 9105 - DNA, 18 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (18)..(18): bicyclic nucleic acid (BNA)
catcaaggaagatggcat

SEQ ID NO: 9106 - DNA, 17 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (17)..(17): bicyclic nucleic acid (BNA)
catcaaggaagatggca

SEQ ID NO: 9107 - DNA, 16 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (16)..(16): bicyclic nucleic acid (BNA)
catcaaggaagatggc

SEQ ID NO: 9108 - DNA, 15 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (15)..(15): bicyclic nucleic acid (BNA)
catcaaggaagatgg

SEQ ID NO: 9109 - DNA, 14 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (14)..(14): bicyclic nucleic acid (BNA)
catcaaggaagatg

SEQ ID NO: 9110 - DNA, 13 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (13)..(13): bicyclic nucleic acid (BNA)
catcaaggaagat

SEQ ID NO: 9111 - DNA, 12 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (12)..(12): bicyclic nucleic acid (BNA)
catcaaggaaga

SEQ ID NO: 9112 - DNA, 11 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (11)..(11): bicyclic nucleic acid (BNA)
catcaaggaag

SEQ ID NO: 9113 - DNA, 23 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
  misc_feature (23)..(23): bicyclic nucleic acid (BNA)
atcaaggaagatggcatttctag

SEQ ID NO: 9114 - DNA, 22 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
  misc_feature (22)..(22): bicyclic nucleic acid (BNA)
atcaaggaagatggcatttcta

SEQ ID NO: 9115 - DNA, 21 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
  misc_feature (21)..(21): bicyclic nucleic acid (BNA)
atcaaggaagatggcatttct

SEQ ID NO: 9116 - DNA, 20 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
  misc_feature (20)..(20): bicyclic nucleic acid (BNA)
atcaaggaagatggcatttc

SEQ ID NO: 9117 - DNA, 19 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (19)..(19): bicyclic nucleic acid (BNA)
atcaaggaagatggcattt

SEQ ID NO: 9118 - DNA, 18 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (18)..(18): bicyclic nucleic acid (BNA)
atcaaggaagatggcatt

SEQ ID NO: 9119 - DNA, 17 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (17)..(17): bicyclic nucleic acid (BNA)
atcaaggaagatggcat

SEQ ID NO: 9120 - DNA, 16 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (16)..(16): bicyclic nucleic acid (BNA)
atcaaggaagatggca

SEQ ID NO: 9121 - DNA, 15 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (15)..(15): bicyclic nucleic acid (BNA)
atcaaggaagatggc

SEQ ID NO: 9122 - DNA, 14 bp, Artificial Sequence
  Description of Artificial Sequence: Synthetic Antisense oligonucleotide
  misc_feature (3)..(3): 5-methyl
  misc_feature (14)..(14): bicyclic nucleic acid (BNA)
atcaaggaagatgg

SEQ ID NO: 9123 - DNA, 13 bp, Artificial Sequence
  Description of Artificial Sequence: Synthetic Antisense oligonucleotide
  misc_feature (3)..(3): 5-methyl
  misc_feature (13)..(13): bicyclic nucleic acid (BNA)
atcaaggaagatg

SEQ ID NO: 9124 - DNA, 12 bp, Artificial Sequence
  Description of Artificial Sequence: Synthetic Antisense oligonucleotide
  misc_feature (3)..(3): 5-methyl
  misc_feature (12)..(12): bicyclic nucleic acid (BNA)
atcaaggaagat

SEQ ID NO: 9125 - DNA, 11 bp, Artificial Sequence
  Description of Artificial Sequence: Synthetic Antisense oligonucleotide
  misc_feature (3)..(3): 5-methyl
  misc_feature (11)..(11): bicyclic nucleic acid (BNA)
atcaaggaaga

SEQ ID NO: 9126 - DNA, 10 bp, Artificial Sequence
  Description of Artificial Sequence: Synthetic Antisense oligonucleotide
  misc_feature (3)..(3): 5-methyl
  misc_feature (10)..(10): bicyclic nucleic acid (BNA)
atcaaggaag

SEQ ID NO: 9127 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 9128 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 9129 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 9130 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (18)..(18): bicyclic nucleic acid (BNA)
ctgtccaagcccggttga

SEQ ID NO: 9131 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (7)..(7): 5-methyl
  misc_feature (11)..(12): 5-methyl
taagttctgtccaag

SEQ ID NO: 9132 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (3)..(3): 5-methyl
  misc_feature (7)..(8): 5-methyl
  misc_feature (12)..(14): 5-methyl
ttctgtccaagcccggttga

SEQ ID NO: 9133 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (3)..(3): 5-methyl
  misc_feature (7)..(8): 5-methyl
  misc_feature (12)..(14): 5-methyl
ttctgtccaagcccggttg

SEQ ID NO: 9134 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (3)..(3): 5-methyl
  misc_feature (7)..(8): 5-methyl
  misc_feature (12)..(14): 5-methyl
ttctgtccaagcccggtt

SEQ ID NO: 9135 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (3)..(3): 5-methyl
  misc_feature (7)..(8): 5-methyl
  misc_feature (12)..(14): 5-methyl
ttctgtccaagcccggt

SEQ ID NO: 9136 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (3)..(3): 5-methyl
  misc_feature (7)..(8): 5-methyl
  misc_feature (12)..(14): 5-methyl
ttctgtccaagcccgg

SEQ ID NO: 9137 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (3)..(3): 5-methyl
  misc_feature (7)..(8): 5-methyl
  misc_feature (12)..(14): 5-methyl
ttctgtccaagcccg

SEQ ID NO: 9138 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (3)..(3): 5-methyl
  misc_feature (7)..(8): 5-methyl
  misc_feature (12)..(14): 5-methyl
ttctgtccaagccc

SEQ ID NO: 9139 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (3)..(3): 5-methyl
  misc_feature (7)..(8): 5-methyl
  misc_feature (12)..(13): 5-methyl
ttctgtccaagcc

SEQ ID NO: 9140 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (3)..(3): 5-methyl
  misc_feature (7)..(8): 5-methyl
  misc_feature (12)..(12): 5-methyl
ttctgtccaagc

SEQ ID NO: 9141 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (3)..(3): 5-methyl
  misc_feature (7)..(8): 5-methyl
ttctgtccaag

SEQ ID NO: 9142 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (3)..(3): 5-methyl
  misc_feature (7)..(8): 5-methyl
ttctgtccaa

SEQ ID NO: 9143 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (3)..(3): 5-methyl
  misc_feature (7)..(8): 5-methyl
ttctgtcca

SEQ ID NO: 9144 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (3)..(3): 5-methyl
  misc_feature (7)..(8): 5-methyl
ttctgtcc

SEQ ID NO: 9145 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (2)..(2): 5-methyl
  misc_feature (6)..(7): 5-methyl
  misc_feature (11)..(13): 5-methyl
tctgtccaagcccggttga

SEQ ID NO: 9146 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (2)..(2): 5-methyl
  misc_feature (6)..(7): 5-methyl
  misc_feature (11)..(13): 5-methyl
tctgtccaagcccggttg

SEQ ID NO: 9147 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (2)..(2): 5-methyl
  misc_feature (6)..(7): 5-methyl
  misc_feature (11)..(13): 5-methyl
tctgtccaagcccggtt

SEQ ID NO: 9148 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (2)..(2): 5-methyl
  misc_feature (6)..(7): 5-methyl
  misc_feature (11)..(13): 5-methyl
tctgtccaagcccggt

SEQ ID NO: 9149 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (2)..(2): 5-methyl
  misc_feature (6)..(7): 5-methyl
  misc_feature (11)..(13): 5-methyl
tctgtccaagcccgg

SEQ ID NO: 9150 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (2)..(2): 5-methyl
  misc_feature (6)..(7): 5-methyl
  misc_feature (11)..(13): 5-methyl
tctgtccaagcccg

SEQ ID NO: 9151 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (2)..(2): 5-methyl
  misc_feature (6)..(7): 5-methyl
  misc_feature (11)..(13): 5-methyl
tctgtccaagccc

SEQ ID NO: 9152 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (2)..(2): 5-methyl
  misc_feature (6)..(7): 5-methyl
  misc_feature (11)..(12): 5-methyl
tctgtccaagcc

SEQ ID NO: 9153 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (2)..(2): 5-methyl
  misc_feature (6)..(7): 5-methyl
  misc_feature (11)..(11): 5-methyl
tctgtccaagc

SEQ ID NO: 9154 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (2)..(2): 5-methyl
  misc_feature (6)..(7): 5-methyl
tctgtccaag

SEQ ID NO: 9155 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (2)..(2): 5-methyl
  misc_feature (6)..(7): 5-methyl
tctgtccaa

SEQ ID NO: 9156 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (2)..(2): 5-methyl
  misc_feature (6)..(7): 5-methyl
tctgtcca

SEQ ID NO: 9157 - DNA, 17 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (17)..(17): bicyclic nucleic acid (BNA)
ctgtccaagcccggttg

SEQ ID NO: 9158 - DNA, 16 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (16)..(16): bicyclic nucleic acid (BNA)
ctgtccaagcccggtt

SEQ ID NO: 9159 - DNA, 15 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (15)..(15): bicyclic nucleic acid (BNA)
ctgtccaagcccggt

SEQ ID NO: 9160 - DNA, 14 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (14)..(14): bicyclic nucleic acid (BNA)
ctgtccaagcccgg

SEQ ID NO: 9161 - DNA, 13 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(13): bicyclic nucleic acid (BNA)
ctgtccaagcccg

SEQ ID NO: 9162 - DNA, 12 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(12): bicyclic nucleic acid (BNA)
ctgtccaagccc

SEQ ID NO: 9163 - DNA, 11 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(11): 5-methyl
  misc_feature (1)..(1): bicyclic nucleic acid (BNA)
  misc_feature (11)..(11): bicyclic nucleic acid (BNA)
ctgtccaagcc

SEQ ID NO: 9164 - DNA, 10 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(10): 5-methyl
  misc_feature (1)..(1): bicyclic nucleic acid (BNA)
  misc_feature (10)..(10): bicyclic nucleic acid (BNA)
ctgtccaagc

SEQ ID NO: 9165 - DNA, 9 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (1)..(1): bicyclic nucleic acid (BNA)
  misc_feature (9)..(9): bicyclic nucleic acid (BNA)
ctgtccaag

SEQ ID NO: 9166 - DNA, 8 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (1)..(1): bicyclic nucleic acid (BNA)
  misc_feature (8)..(8): bicyclic nucleic acid (BNA)
ctgtccaa

SEQ ID NO: 9167 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (4)..(4): 5-methyl
  misc_feature (8)..(9): 5-methyl
  misc_feature (13)..(15): 5-methyl
gttctgtccaagcccggttg

SEQ ID NO: 9168 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (4)..(4): 5-methyl
  misc_feature (8)..(9): 5-methyl
  misc_feature (13)..(15): 5-methyl
gttctgtccaagcccggtt

SEQ ID NO: 9169 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (4)..(4): 5-methyl
  misc_feature (8)..(9): 5-methyl
  misc_feature (13)..(15): 5-methyl
gttctgtccaagcccggt

SEQ ID NO: 9170 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (4)..(4): 5-methyl
  misc_feature (8)..(9): 5-methyl
  misc_feature (13)..(15): 5-methyl
gttctgtccaagcccgg

SEQ ID NO: 9171 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (4)..(4): 5-methyl
  misc_feature (8)..(9): 5-methyl
  misc_feature (13)..(15): 5-methyl
gttctgtccaagcccg

SEQ ID NO: 9172 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (4)..(4): 5-methyl
  misc_feature (8)..(9): 5-methyl
  misc_feature (13)..(15): 5-methyl
gttctgtccaagccc

SEQ ID NO: 9173 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (4)..(4): 5-methyl
  misc_feature (8)..(9): 5-methyl
  misc_feature (13)..(14): 5-methyl
gttctgtccaagcc

SEQ ID NO: 9174 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (4)..(4): 5-methyl
  misc_feature (8)..(9): 5-methyl
  misc_feature (13)..(13): 5-methyl
gttctgtccaagc

SEQ ID NO: 9175 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (4)..(4): 5-methyl
  misc_feature (8)..(9): 5-methyl
gttctgtccaag

SEQ ID NO: 9176 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (4)..(4): 5-methyl
  misc_feature (8)..(9): 5-methyl
gttctgtccaa

SEQ ID NO: 9177 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (4)..(4): 5-methyl
  misc_feature (8)..(9): 5-methyl
gttctgtcca

SEQ ID NO: 9178 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (4)..(4): 5-methyl
  misc_feature (8)..(9): 5-methyl
gttctgtcc

SEQ ID NO: 9179 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (4)..(4): 5-methyl
  misc_feature (8)..(8): 5-methyl
gttctgtc

SEQ ID NO: 9180 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (5)..(5): 5-methyl
  misc_feature (9)..(10): 5-methyl
  misc_feature (14)..(16): 5-methyl
agttctgtccaagcccggtt

SEQ ID NO: 9181 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (5)..(5): 5-methyl
  misc_feature (9)..(10): 5-methyl
  misc_feature (14)..(16): 5-methyl
agttctgtccaagcccggt

SEQ ID NO: 9182 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (5)..(5): 5-methyl
  misc_feature (9)..(10): 5-methyl
  misc_feature (14)..(16): 5-methyl
agttctgtccaagcccgg

SEQ ID NO: 9183 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (5)..(5): 5-methyl
  misc_feature (9)..(10): 5-methyl
  misc_feature (14)..(16): 5-methyl
agttctgtccaagcccg

SEQ ID NO: 9184 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (5)..(5): 5-methyl
  misc_feature (9)..(10): 5-methyl
  misc_feature (14)..(16): 5-methyl
agttctgtccaagccc

SEQ ID NO: 9185 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (5)..(5): 5-methyl
  misc_feature (9)..(10): 5-methyl
  misc_feature (14)..(15): 5-methyl
agttctgtccaagcc

SEQ ID NO: 9186 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (5)..(5): 5-methyl
  misc_feature (9)..(10): 5-methyl
  misc_feature (14)..(14): 5-methyl
agttctgtccaagc

SEQ ID NO: 9187 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (5)..(5): 5-methyl
  misc_feature (9)..(10): 5-methyl
agttctgtccaag

SEQ ID NO: 9188 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (5)..(5): 5-methyl
  misc_feature (9)..(10): 5-methyl
agttctgtccaa

SEQ ID NO: 9189 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (5)..(5): 5-methyl
  misc_feature (9)..(10): 5-methyl
agttctgtcca

SEQ ID NO: 9190 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (5)..(5): 5-methyl
  misc_feature (9)..(10): 5-methyl
agttctgtcc

SEQ ID NO: 9191 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (5)..(5): 5-methyl
  misc_feature (9)..(9): 5-methyl
agttctgtc

SEQ ID NO: 9192 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (5)..(5): 5-methyl
agttctgt

SEQ ID NO: 9193 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (6)..(6): 5-methyl
  misc_feature (10)..(11): 5-methyl
  misc_feature (15)..(17): 5-methyl
aagttctgtccaagcccggt

SEQ ID NO: 9194 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (6)..(6): 5-methyl
  misc_feature (10)..(11): 5-methyl
  misc_feature (15)..(17): 5-methyl
aagttctgtccaagcccgg

SEQ ID NO: 9195 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (6)..(6): 5-methyl
  misc_feature (10)..(11): 5-methyl
  misc_feature (15)..(17): 5-methyl
aagttctgtccaagcccg

SEQ ID NO: 9196 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (6)..(6): 5-methyl
  misc_feature (10)..(11): 5-methyl
  misc_feature (15)..(17): 5-methyl
aagttctgtccaagccc

SEQ ID NO: 9197 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (6)..(6): 5-methyl
  misc_feature (10)..(11): 5-methyl
  misc_feature (15)..(16): 5-methyl
aagttctgtccaagcc

SEQ ID NO: 9198 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (6)..(6): 5-methyl
  misc_feature (10)..(11): 5-methyl
  misc_feature (15)..(15): 5-methyl
aagttctgtccaagc

SEQ ID NO: 9199 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (6)..(6): 5-methyl
  misc_feature (10)..(11): 5-methyl
aagttctgtccaag

SEQ ID NO: 9200 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (6)..(6): 5-methyl
  misc_feature (10)..(11): 5-methyl
aagttctgtccaa

SEQ ID NO: 9201 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (6)..(6): 5-methyl
  misc_feature (10)..(11): 5-methyl
aagttctgtcca

SEQ ID NO: 9202 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (6)..(6): 5-methyl
  misc_feature (10)..(11): 5-methyl
aagttctgtcc

SEQ ID NO: 9203 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (6)..(6): 5-methyl
  misc_feature (10)..(10): 5-methyl
aagttctgtc

SEQ ID NO: 9204 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (6)..(6): 5-methyl
aagttctgt

SEQ ID NO: 9205 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (6)..(6): 5-methyl
aagttctg

SEQ ID NO: 9206 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (7)..(7): 5-methyl
  misc_feature (11)..(12): 5-methyl
  misc_feature (16)..(18): 5-methyl
taagttctgtccaagcccgg

SEQ ID NO: 9207 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (7)..(7): 5-methyl
  misc_feature (11)..(12): 5-methyl
  misc_feature (16)..(18): 5-methyl
taagttctgtccaagcccg

SEQ ID NO: 9208 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (7)..(7): 5-methyl
  misc_feature (11)..(12): 5-methyl
  misc_feature (16)..(18): 5-methyl
taagttctgtccaagccc

SEQ ID NO: 9209 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (7)..(7): 5-methyl
  misc_feature (11)..(12): 5-methyl
  misc_feature (16)..(17): 5-methyl
taagttctgtccaagcc

SEQ ID NO: 9210 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (7)..(7): 5-methyl
  misc_feature (11)..(12): 5-methyl
  misc_feature (16)..(16): 5-methyl
taagttctgtccaagc

SEQ ID NO: 9211 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (7)..(7): 5-methyl
  misc_feature (11)..(12): 5-methyl
taagttctgtccaa

SEQ ID NO: 9212 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (7)..(7): 5-methyl
  misc_feature (11)..(12): 5-methyl
taagttctgtcca

SEQ ID NO: 9213 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (7)..(7): 5-methyl
  misc_feature (11)..(12): 5-methyl
taagttctgtcc

SEQ ID NO: 9214 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (7)..(7): 5-methyl
  misc_feature (11)..(11): 5-methyl
taagttctgtc

SEQ ID NO: 9215 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (7)..(7): 5-methyl
taagttctgt

SEQ ID NO: 9216 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (7)..(7): 5-methyl
taagttctg

SEQ ID NO: 9217 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (7)..(7): 5-methyl
taagttct

SEQ ID NO: 9218 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (8)..(8): 5-methyl
  misc_feature (12)..(13): 5-methyl
  misc_feature (17)..(19): 5-methyl
gtaagttctgtccaagcccg

SEQ ID NO: 9219 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (8)..(8): 5-methyl
  misc_feature (12)..(13): 5-methyl
  misc_feature (17)..(19): 5-methyl
gtaagttctgtccaagccc

SEQ ID NO: 9220 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(17): 5-methyl
gtaagttctgtccaagc

SEQ ID NO: 9221 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (8)..(8): 5-methyl
  misc_feature (12)..(13): 5-methyl
gtaagttctgtccaag

SEQ ID NO: 9222 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (8)..(8): 5-methyl
  misc_feature (12)..(13): 5-methyl
gtaagttctgtccaa

SEQ ID NO: 9223 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (8)..(8): 5-methyl
  misc_feature (12)..(13): 5-methyl
gtaagttctgtcca

SEQ ID NO: 9224 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (8)..(8): 5-methyl
  misc_feature (12)..(13): 5-methyl
gtaagttctgtcc

SEQ ID NO: 9225 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (8)..(8): 5-methyl
  misc_feature (12)..(12): 5-methyl
gtaagttctgtc

SEQ ID NO: 9226 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (8)..(8): 5-methyl
gtaagttctgt

SEQ ID NO: 9227 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (8)..(8): 5-methyl
gtaagttctg

SEQ ID NO: 9228 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (8)..(8): 5-methyl
gtaagttct

SEQ ID NO: 9229 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (8)..(8): 5-methyl
gtaagttc

SEQ ID NO: 9230 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (9)..(9): 5-methyl
  misc_feature (13)..(14): 5-methyl
  misc_feature (18)..(20): 5-methyl
ggtaagttctgtccaagccc

SEQ ID NO: 9231 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (9)..(9): 5-methyl
  misc_feature (13)..(14): 5-methyl
  misc_feature (18)..(19): 5-methyl
ggtaagttctgtccaagcc

SEQ ID NO: 9232 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (9)..(9): 5-methyl
  misc_feature (13)..(14): 5-methyl
ggtaagttctgtccaag

SEQ ID NO: 9233 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (9)..(9): 5-methyl
  misc_feature (13)..(14): 5-methyl
ggtaagttctgtccaa

SEQ ID NO: 9234 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (9)..(9): 5-methyl
  misc_feature (13)..(14): 5-methyl
ggtaagttctgtcca

SEQ ID NO: 9235 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (9)..(9): 5-methyl
  misc_feature (13)..(14): 5-methyl
ggtaagttctgtcc

SEQ ID NO: 9236 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (9)..(9): 5-methyl
  misc_feature (13)..(13): 5-methyl
ggtaagttctgtc

SEQ ID NO: 9237 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (9)..(9): 5-methyl
ggtaagttctgt

SEQ ID NO: 9238 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (9)..(9): 5-methyl
ggtaagttctg

SEQ ID NO: 9239 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (9)..(9): 5-methyl
ggtaagttct

SEQ ID NO: 9240 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (9)..(9): 5-methyl
ggtaagttc

SEQ ID NO: 9241 - DNA, 20 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(20): 5-methyl
  misc_feature (1)..(1): bicyclic nucleic acid (BNA)
  misc_feature (20)..(20): bicyclic nucleic acid (BNA)
cggtaagttctgtccaagcc

SEQ ID NO: 9242 - DNA, 19 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(19): 5-methyl
  misc_feature (1)..(1): bicyclic nucleic acid (BNA)
  misc_feature (19)..(19): bicyclic nucleic acid (BNA)
cggtaagttctgtccaagc

SEQ ID NO: 9243 - DNA, 18 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(1): bicyclic nucleic acid (BNA)
  misc_feature (18)..(18): bicyclic nucleic acid (BNA)
cggtaagttctgtccaag

SEQ ID NO: 9244 - DNA, 17 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(1): bicyclic nucleic acid (BNA)
  misc_feature (17)..(17): bicyclic nucleic acid (BNA)
cggtaagttctgtccaa

SEQ ID NO: 9245 - DNA, 16 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(1): bicyclic nucleic acid (BNA)
  misc_feature (16)..(16): bicyclic nucleic acid (BNA)
cggtaagttctgtcca

SEQ ID NO: 9246 - DNA, 15 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(1): bicyclic nucleic acid (BNA)
  misc_feature (15)..(15): bicyclic nucleic acid (BNA)
cggtaagttctgtcc

SEQ ID NO: 9247 - DNA, 14 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(14): 5-methyl
  misc_feature (1)..(1): bicyclic nucleic acid (BNA)
  misc_feature (14)..(14): bicyclic nucleic acid (BNA)
cggtaagttctgtc

SEQ ID NO: 9248 - DNA, 13 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(1): bicyclic nucleic acid (BNA)
  misc_feature (13)..(13): bicyclic nucleic acid (BNA)
cggtaagttctgt

SEQ ID NO: 9249 - DNA, 12 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(1): bicyclic nucleic acid (BNA)
  misc_feature (12)..(12): bicyclic nucleic acid (BNA)
cggtaagttctg

SEQ ID NO: 9250 - DNA, 11 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(1): bicyclic nucleic acid (BNA)
  misc_feature (11)..(11): bicyclic nucleic acid (BNA)
cggtaagttct

SEQ ID NO: 9251 - DNA, 10 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(1): bicyclic nucleic acid (BNA)
  misc_feature (10)..(10): bicyclic nucleic acid (BNA)
cggtaagttc

SEQ ID NO: 9252 - DNA, 9 bp, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
  misc_feature (9)..(9): bicyclic nucleic acid (BNA)
cggtaagtt

SEQ ID NO: 9253 - DNA, 8 bp, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
  misc_feature (8)..(8): bicyclic nucleic acid (BNA)
cggtaagt

SEQ ID NO: 9254 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (2)..(2): 5-methyl
  misc_feature (11)..(11): 5-methyl
  misc_feature (15)..(16): 5-methyl
  misc_feature (20)..(20): 5-methyl
tcggtaagttctgtccaagc

SEQ ID NO: 9255 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (2)..(2): 5-methyl
  misc_feature (11)..(11): 5-methyl
  misc_feature (15)..(16): 5-methyl
tcggtaagttctgtccaag

SEQ ID NO: 9256 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (2)..(2): 5-methyl
  misc_feature (11)..(11): 5-methyl
  misc_feature (15)..(16): 5-methyl
tcggtaagttctgtccaa

SEQ ID NO: 9257 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (2)..(2): 5-methyl
  misc_feature (11)..(11): 5-methyl
  misc_feature (15)..(16): 5-methyl
tcggtaagttctgtcca

SEQ ID NO: 9258 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (2)..(2): 5-methyl
  misc_feature (11)..(11): 5-methyl
  misc_feature (15)..(16): 5-methyl
tcggtaagttctgtcc

SEQ ID NO: 9259 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (2)..(2): 5-methyl
  misc_feature (11)..(11): 5-methyl
  misc_feature (15)..(15): 5-methyl
tcggtaagttctgtc

SEQ ID NO: 9260 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (2)..(2): 5-methyl
  misc_feature (11)..(11): 5-methyl
tcggtaagttctgt

SEQ ID NO: 9261 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (2)..(2): 5-methyl
  misc_feature (11)..(11): 5-methyl
tcggtaagttctg

SEQ ID NO: 9262 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (2)..(2): 5-methyl
  misc_feature (11)..(11): 5-methyl
tcggtaagttct

SEQ ID NO: 9263 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (2)..(2): 5-methyl
  misc_feature (11)..(11): 5-methyl
tcggtaagttc

SEQ ID NO: 9264 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (2)..(2): 5-methyl
tcggtaagtt

SEQ ID NO: 9265 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (2)..(2): 5-methyl
tcggtaagt

SEQ ID NO: 9266 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (3)..(3): 5-methyl
  misc_feature (12)..(12): 5-methyl
  misc_feature (16)..(17): 5-methyl
gtcggtaagttctgtccaag

SEQ ID NO: 9267 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (3)..(3): 5-methyl
  misc_feature (12)..(12): 5-methyl
  misc_feature (16)..(17): 5-methyl
gtcggtaagttctgtccaa

SEQ ID NO: 9268 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (3)..(3): 5-methyl
  misc_feature (12)..(12): 5-methyl
  misc_feature (16)..(17): 5-methyl
gtcggtaagttctgtcca

SEQ ID NO: 9269 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (3)..(3): 5-methyl
  misc_feature (12)..(12): 5-methyl
  misc_feature (16)..(17): 5-methyl
gtcggtaagttctgtcc

SEQ ID NO: 9270 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (3)..(3): 5-methyl
  misc_feature (12)..(12): 5-methyl
  misc_feature (16)..(16): 5-methyl
gtcggtaagttctgtc

SEQ ID NO: 9271 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (3)..(3): 5-methyl
  misc_feature (12)..(12): 5-methyl
gtcggtaagttctgt

SEQ ID NO: 9272 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (3)..(3): 5-methyl
  misc_feature (12)..(12): 5-methyl
gtcggtaagttctg

SEQ ID NO: 9273 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (3)..(3): 5-methyl
  misc_feature (12)..(12): 5-methyl
gtcggtaagttct

SEQ ID NO: 9274 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (3)..(3): 5-methyl
  misc_feature (12)..(12): 5-methyl
gtcggtaagttc

SEQ ID NO: 9275 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (3)..(3): 5-methyl
gtcggtaagtt

SEQ ID NO: 9276 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (3)..(3): 5-methyl
gtcggtaagt

SEQ ID NO: 9277 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (4)..(4): 5-methyl
  misc_feature (13)..(13): 5-methyl
  misc_feature (17)..(18): 5-methyl
agtcggtaagttctgtccaa

SEQ ID NO: 9278 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcca

SEQ ID NO: 9279 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(17): 5-methyl
agtcggtaagttctgtc

SEQ ID NO: 9280 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (4)..(4): 5-methyl
  misc_feature (13)..(13): 5-methyl
agtcggtaagttctgt

SEQ ID NO: 9281 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (4)..(4): 5-methyl
  misc_feature (13)..(13): 5-methyl
agtcggtaagttctg

SEQ ID NO: 9282 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (4)..(4): 5-methyl
  misc_feature (13)..(13): 5-methyl
agtcggtaagttct

SEQ ID NO: 9283 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (4)..(4): 5-methyl
  misc_feature (13)..(13): 5-methyl
agtcggtaagttc

SEQ ID NO: 9284 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (4)..(4): 5-methyl
agtcggtaagtt

SEQ ID NO: 9285 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (4)..(4): 5-methyl
agtcggtaagt

SEQ ID NO: 9286 - DNA, 20 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (1)..(1): bicyclic nucleic acid (BNA)
  misc_feature (20)..(20): bicyclic nucleic acid (BNA)
cagtcggtaagttctgtcca

SEQ ID NO: 9287 - DNA, 19 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (1)..(1): bicyclic nucleic acid (BNA)
  misc_feature (19)..(19): bicyclic nucleic acid (BNA)
cagtcggtaagttctgtcc

SEQ ID NO: 9288 - DNA, 18 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(18): 5-methyl
  misc_feature (1)..(1): bicyclic nucleic acid (BNA)
  misc_feature (18)..(18): bicyclic nucleic acid (BNA)
cagtcggtaagttctgtc

SEQ ID NO: 9289 - DNA, 17 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(1): bicyclic nucleic acid (BNA)
  misc_feature (17)..(17): bicyclic nucleic acid (BNA)
cagtcggtaagttctgt

SEQ ID NO: 9290 - DNA, 16 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(1): bicyclic nucleic acid (BNA)
  misc_feature (16)..(16): bicyclic nucleic acid (BNA)
cagtcggtaagttctg

SEQ ID NO: 9291 - DNA, 15 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(1): bicyclic nucleic acid (BNA)
  misc_feature (15)..(15): bicyclic nucleic acid (BNA)
cagtcggtaagttct

SEQ ID NO: 9292 - DNA, 14 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(1): bicyclic nucleic acid (BNA)
  misc_feature (14)..(14): bicyclic nucleic acid (BNA)
cagtcggtaagttc

SEQ ID NO: 9293 - DNA, 13 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (1)..(1): bicyclic nucleic acid (BNA)
  misc_feature (13)..(13): bicyclic nucleic acid (BNA)
cagtcggtaagtt

SEQ ID NO: 9294 - DNA, 12 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (1)..(1): bicyclic nucleic acid (BNA)
  misc_feature (12)..(12): bicyclic nucleic acid (BNA)
cagtcggtaagt

SEQ ID NO: 9295 - DNA, 20 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(20): 5-methyl
  misc_feature (1)..(1): bicyclic nucleic acid (BNA)
  misc_feature (20)..(20): bicyclic nucleic acid (BNA)
ccagtcggtaagttctgtcc

SEQ ID NO: 9296 - DNA, 19 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(19): 5-methyl
  misc_feature (1)..(1): bicyclic nucleic acid (BNA)
  misc_feature (19)..(19): bicyclic nucleic acid (BNA)
ccagtcggtaagttctgtc

SEQ ID NO: 9297 - DNA, 18 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(1): bicyclic nucleic acid (BNA)
  misc_feature (18)..(18): bicyclic nucleic acid (BNA)
ccagtcggtaagttctgt

SEQ ID NO: 9298 - DNA, 17 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(1): bicyclic nucleic acid (BNA)
  misc_feature (17)..(17): bicyclic nucleic acid (BNA)
ccagtcggtaagttctg

SEQ ID NO: 9299 - DNA, 16 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(1): bicyclic nucleic acid (BNA)
  misc_feature (16)..(16): bicyclic nucleic acid (BNA)
ccagtcggtaagttct

SEQ ID NO: 9300 - DNA, 15 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(1): bicyclic nucleic acid (BNA)
  misc_feature (15)..(15): bicyclic nucleic acid (BNA)
ccagtcggtaagttc

SEQ ID NO: 9301 - DNA, 14 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (1)..(1): bicyclic nucleic acid (BNA)
  misc_feature (14)..(14): bicyclic nucleic acid (BNA)
ccagtcggtaagtt

SEQ ID NO: 9302 - DNA, 13 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (1)..(1): bicyclic nucleic acid (BNA)
  misc_feature (13)..(13): bicyclic nucleic acid (BNA)
ccagtcggtaagt

SEQ ID NO: 9303 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (2)..(3): 5-methyl
  misc_feature (7)..(7): 5-methyl
  misc_feature (16)..(16): 5-methyl
  misc_feature (20)..(20): 5-methyl
gccagtcggtaagttctgtc

SEQ ID NO: 9304 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (2)..(3): 5-methyl
  misc_feature (7)..(7): 5-methyl
  misc_feature (16)..(16): 5-methyl
gccagtcggtaagttctgt

SEQ ID NO: 9305 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (2)..(3): 5-methyl
  misc_feature (7)..(7): 5-methyl
  misc_feature (16)..(16): 5-methyl
gccagtcggtaagttctg

SEQ ID NO: 9306 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (2)..(3): 5-methyl
  misc_feature (7)..(7): 5-methyl
  misc_feature (16)..(16): 5-methyl
gccagtcggtaagttct

SEQ ID NO: 9307 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (2)..(3): 5-methyl
  misc_feature (7)..(7): 5-methyl
  misc_feature (16)..(16): 5-methyl
gccagtcggtaagttc

SEQ ID NO: 9308 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (2)..(3): 5-methyl
  misc_feature (7)..(7): 5-methyl
gccagtcggtaagtt

SEQ ID NO: 9309 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (2)..(3): 5-methyl
  misc_feature (7)..(7): 5-methyl
gccagtcggtaagt

SEQ ID NO: 9310 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 9311 - DNA, 22 bp, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 9312 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (2)..(2): 5-methyl
  misc_feature (14)..(14): 5-methyl
tcaaggaagatggcat

SEQ ID NO: 9313 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (9)..(9): 5-methyl
  misc_feature (14)..(14): 5-methyl
gaagatggcatttct

SEQ ID NO: 9314 - DNA, 21 bp, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttcta

SEQ ID NO: 9315 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttc

SEQ ID NO: 9316 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (2)..(2): 5-methyl
  misc_feature (14)..(14): 5-methyl
tcaaggaagatggcattt

SEQ ID NO: 9317 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (2)..(2): 5-methyl
  misc_feature (14)..(14): 5-methyl
tcaaggaagatggcatt

SEQ ID NO: 9318 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (2)..(2): 5-methyl
  misc_feature (14)..(14): 5-methyl
tcaaggaagatggca

SEQ ID NO: 9319 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (2)..(2): 5-methyl
  misc_feature (14)..(14): 5-methyl
tcaaggaagatggc

SEQ ID NO: 9320 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (2)..(2): 5-methyl
tcaaggaagatgg

SEQ ID NO: 9321 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (2)..(2): 5-methyl
tcaaggaagatg

SEQ ID NO: 9322 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (2)..(2): 5-methyl
tcaaggaagat

SEQ ID NO: 9323 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (2)..(2): 5-methyl
tcaaggaaga

SEQ ID NO: 9324 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (2)..(2): 5-methyl
tcaaggaag

SEQ ID NO: 9325 - DNA, 21 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(1): bicyclic nucleic acid (BNA)
  misc_feature (21)..(21): bicyclic nucleic acid (BNA)
caaggaagatggcatttctag

SEQ ID NO: 9326 - DNA, 20 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(1): bicyclic nucleic acid (BNA)
  misc_feature (20)..(20): bicyclic nucleic acid (BNA)
caaggaagatggcatttcta

SEQ ID NO: 9327 - DNA, 19 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(1): bicyclic nucleic acid (BNA)
  misc_feature (19)..(19): bicyclic nucleic acid (BNA)
caaggaagatggcatttct

SEQ ID NO: 9328 - DNA, 18 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(1): bicyclic nucleic acid (BNA)
  misc_feature (18)..(18): bicyclic nucleic acid (BNA)
caaggaagatggcatttc

SEQ ID NO: 9329 - DNA, 17 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(1): bicyclic nucleic acid (BNA)
  misc_feature (17)..(17): bicyclic nucleic acid (BNA)
caaggaagatggcattt

SEQ ID NO: 9330 - DNA, 16 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(1): bicyclic nucleic acid (BNA)
  misc_feature (16)..(16): bicyclic nucleic acid (BNA)
caaggaagatggcatt

SEQ ID NO: 9331 - DNA, 15 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(1): bicyclic nucleic acid (BNA)
  misc_feature (15)..(15): bicyclic nucleic acid (BNA)
caaggaagatggcat

SEQ ID NO: 9332 - DNA, 14 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(1): bicyclic nucleic acid (BNA)
  misc_feature (14)..(14): bicyclic nucleic acid (BNA)
caaggaagatggca

SEQ ID NO: 9333 - DNA, 13 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(1): bicyclic nucleic acid (BNA)
  misc_feature (13)..(13): bicyclic nucleic acid (BNA)
caaggaagatggc

SEQ ID NO: 9334 - DNA, 12 bp, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
  misc_feature (12)..(12): bicyclic nucleic acid (BNA)
caaggaagatgg

SEQ ID NO: 9335 - DNA, 11 bp, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
  misc_feature (11)..(11): bicyclic nucleic acid (BNA)
caaggaagatg

SEQ ID NO: 9336 - DNA, 10 bp, Artificial Sequence
  Description of Artificial Sequence: Synthetic Antisense oligonucleotide
  misc_feature (1)..(1): 5-methyl
  misc_feature (1)..(1): bicyclic nucleic acid (BNA)
  misc_feature (10)..(10): bicyclic nucleic acid (BNA)
caaggaagat

SEQ ID NO: 9337 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (12)..(12): 5-methyl
  misc_feature (17)..(17): 5-methyl
aaggaagatggcatttctag

SEQ ID NO: 9338 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (12)..(12): 5-methyl
  misc_feature (17)..(17): 5-methyl
aaggaagatggcatttcta

SEQ ID NO: 9339 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (12)..(12): 5-methyl
  misc_feature (17)..(17): 5-methyl
aaggaagatggcatttct

SEQ ID NO: 9340 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (12)..(12): 5-methyl
  misc_feature (17)..(17): 5-methyl
aaggaagatggcatttc

SEQ ID NO: 9341 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (12)..(12): 5-methyl
aaggaagatggcattt

SEQ ID NO: 9342 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (12)..(12): 5-methyl
aaggaagatggcatt

SEQ ID NO: 9343 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (12)..(12): 5-methyl
aaggaagatggcat

SEQ ID NO: 9344 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (12)..(12): 5-methyl
aaggaagatggca

SEQ ID NO: 9345 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (12)..(12): 5-methyl
aaggaagatggc

SEQ ID NO: 9346 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (11)..(11): 5-methyl
  misc_feature (16)..(16): 5-methyl
aggaagatggcatttctag

SEQ ID NO: 9347 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (11)..(11): 5-methyl
  misc_feature (16)..(16): 5-methyl
aggaagatggcatttcta

SEQ ID NO: 9348 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (11)..(11): 5-methyl
  misc_feature (16)..(16): 5-methyl
aggaagatggcatttct

SEQ ID NO: 9349 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (11)..(11): 5-methyl
  misc_feature (16)..(16): 5-methyl
aggaagatggcatttc

SEQ ID NO: 9350 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (11)..(11): 5-methyl
aggaagatggcattt

SEQ ID NO: 9351 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (11)..(11): 5-methyl
aggaagatggcatt

SEQ ID NO: 9352 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (11)..(11): 5-methyl
aggaagatggcat

SEQ ID NO: 9353 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (11)..(11): 5-methyl
aggaagatggca

SEQ ID NO: 9354 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (10)..(10): 5-methyl
  misc_feature (15)..(15): 5-methyl
ggaagatggcatttctag

SEQ ID NO: 9355 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (10)..(10): 5-methyl
  misc_feature (15)..(15): 5-methyl
ggaagatggcatttcta

SEQ ID NO: 9356 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (10)..(10): 5-methyl
  misc_feature (15)..(15): 5-methyl
ggaagatggcatttct

SEQ ID NO: 9357 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (10)..(10): 5-methyl
  misc_feature (15)..(15): 5-methyl
ggaagatggcatttc

SEQ ID NO: 9358 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (10)..(10): 5-methyl
ggaagatggcattt

SEQ ID NO: 9359 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (10)..(10): 5-methyl
ggaagatggcatt

SEQ ID NO: 9360 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (10)..(10): 5-methyl
ggaagatggcat

SEQ ID NO: 9361 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (10)..(10): 5-methyl
ggaagatggca

SEQ ID NO: 9362 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (10)..(10): 5-methyl
ggaagatggc

SEQ ID NO: 9363 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (9)..(9): 5-methyl
  misc_feature (14)..(14): 5-methyl
gaagatggcatttctag

SEQ ID NO: 9364 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (9)..(9): 5-methyl
  misc_feature (14)..(14): 5-methyl
gaagatggcatttcta

SEQ ID NO: 9365 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (9)..(9): 5-methyl
  misc_feature (14)..(14): 5-methyl
gaagatggcatttc

SEQ ID NO: 9366 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (9)..(9): 5-methyl
gaagatggcattt

SEQ ID NO: 9367 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (9)..(9): 5-methyl
gaagatggcatt

SEQ ID NO: 9368 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (9)..(9): 5-methyl
gaagatggcat

SEQ ID NO: 9369 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (9)..(9): 5-methyl
gaagatggca

SEQ ID NO: 9370 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (9)..(9): 5-methyl
gaagatggc

SEQ ID NO: 9371 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (8)..(8): 5-methyl
  misc_feature (13)..(13): 5-methyl
aagatggcatttctag

SEQ ID NO: 9372 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (8)..(8): 5-methyl
  misc_feature (13)..(13): 5-methyl
aagatggcatttcta

SEQ ID NO: 9373 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (8)..(8): 5-methyl
  misc_feature (13)..(13): 5-methyl
aagatggcatttct

SEQ ID NO: 9374 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (8)..(8): 5-methyl
  misc_feature (13)..(13): 5-methyl
aagatggcatttc

SEQ ID NO: 9375 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (8)..(8): 5-methyl
aagatggcattt

SEQ ID NO: 9376 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (8)..(8): 5-methyl
aagatggcatt

SEQ ID NO: 9377 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (8)..(8): 5-methyl
aagatggcat

SEQ ID NO: 9378 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (8)..(8): 5-methyl
aagatggca

SEQ ID NO: 9379 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (8)..(8): 5-methyl
aagatggc

SEQ ID NO: 9380 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (7)..(7): 5-methyl
  misc_feature (12)..(12): 5-methyl
agatggcatttctag

SEQ ID NO: 9381 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (7)..(7): 5-methyl
  misc_feature (12)..(12): 5-methyl
agatggcatttcta

SEQ ID NO: 9382 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (7)..(7): 5-methyl
  misc_feature (12)..(12): 5-methyl
agatggcatttct

SEQ ID NO: 9383 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (7)..(7): 5-methyl
  misc_feature (12)..(12): 5-methyl
agatggcatttc

SEQ ID NO: 9384 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (7)..(7): 5-methyl
agatggcattt

SEQ ID NO: 9385 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (7)..(7): 5-methyl
agatggcatt

SEQ ID NO: 9386 - DNA, 9 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (7)..(7): 5-methyl
agatggcat

SEQ ID NO: 9387 - DNA, 8 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (7)..(7): 5-methyl
agatggca

SEQ ID NO: 9388 - DNA, 30 bp, Artificial Sequence; identical to SEQ ID NO: 8
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(1): bicyclic nucleic acid (BNA)
  misc_feature (30)..(30): bicyclic nucleic acid (BNA)

SEQ ID NO: 9389 - DNA, 29 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(1): bicyclic nucleic acid (BNA)
  misc_feature (29)..(29): bicyclic nucleic acid (BNA)
ctccaacatcaaggaagatggcatttcta

SEQ ID NO: 9390 - DNA, 28 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(1): bicyclic nucleic acid (BNA)
  misc_feature (28)..(28): bicyclic nucleic acid (BNA)
ctccaacatcaaggaagatggcatttct

SEQ ID NO: 9391 - DNA, 27 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(1): bicyclic nucleic acid (BNA)
  misc_feature (27)..(27): bicyclic nucleic acid (BNA)
ctccaacatcaaggaagatggcatttc

SEQ ID NO: 9392 - DNA, 26 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
  misc_feature (26)..(26): bicyclic nucleic acid (BNA)
ctccaacatcaaggaagatggcattt

SEQ ID NO: 9393 - DNA, 25 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
  misc_feature (25)..(25): bicyclic nucleic acid (BNA)
ctccaacatcaaggaagatggcatt

SEQ ID NO: 9394 - DNA, 24 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
  misc_feature (24)..(24): bicyclic nucleic acid (BNA)
ctccaacatcaaggaagatggcat

SEQ ID NO: 9395 - DNA, 23 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
  misc_feature (23)..(23): bicyclic nucleic acid (BNA)
ctccaacatcaaggaagatggca

SEQ ID NO: 9396 - DNA, 22 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(1): bicyclic nucleic acid (BNA)
  misc_feature (22)..(22): bicyclic nucleic acid (BNA)
ctccaacatcaaggaagatggc

SEQ ID NO: 9397 - DNA, 21 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
  misc_feature (21)..(21): bicyclic nucleic acid (BNA)
ctccaacatcaaggaagatgg

SEQ ID NO: 9398 - DNA, 20 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
  misc_feature (20)..(20): bicyclic nucleic acid (BNA)
ctccaacatcaaggaagatg

SEQ ID NO: 9399 - DNA, 19 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
  misc_feature (19)..(19): bicyclic nucleic acid (BNA)
ctccaacatcaaggaagat

SEQ ID NO: 9400 - DNA, 18 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
  misc_feature (18)..(18): bicyclic nucleic acid (BNA)
ctccaacatcaaggaaga

SEQ ID NO: 9401 - DNA, 17 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(1): bicyclic nucleic acid (BNA)
  misc_feature (17)..(17): bicyclic nucleic acid (BNA)
ctccaacatcaaggaag

SEQ ID NO: 9402 - DNA, 29 bp, Artificial Sequence
  Description of Artificial Sequence: Synthetic Antisense oligonucleotide
  misc_feature (1)..(1): bicyclic nucleic acid (BNA)
  misc_feature (29)..(29): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttctag

SEQ ID NO: 9403 - DNA, 28 bp, Artificial Sequence
  Description of Artificial Sequence: Synthetic Antisense oligonucleotide
  misc_feature (1)..(1): bicyclic nucleic acid (BNA)
  misc_feature (28)..(28): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttcta

SEQ ID NO: 9404 - DNA, 27 bp, Artificial Sequence
  Description of Artificial Sequence: Synthetic Antisense oligonucleotide
  misc_feature (1)..(1): bicyclic nucleic acid (BNA)
  misc_feature (27)..(27): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttct

SEQ ID NO: 9405 - DNA, 26 bp, Artificial Sequence
  Description of Artificial Sequence: Synthetic Antisense oligonucleotide
  misc_feature (1)..(1): bicyclic nucleic acid (BNA)
  misc_feature (26)..(26): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttc

SEQ ID NO: 9406 - DNA, 25 bp, Artificial Sequence
  Description of Artificial Sequence: Synthetic Antisense oligonucleotide
  misc_feature (1)..(1): bicyclic nucleic acid (BNA)
  misc_feature (25)..(25): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggcattt

SEQ ID NO: 9407 - DNA, 24 bp, Artificial Sequence
  Description of Artificial Sequence: Synthetic Antisense oligonucleotide
  misc_feature (1)..(1): bicyclic nucleic acid (BNA)
  misc_feature (24)..(24): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggcatt

SEQ ID NO: 9408 - DNA, 23 bp, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggcat

SEQ ID NO: 9409 - DNA, 22 bp, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggca

SEQ ID NO: 9410 - DNA, 21 bp, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggc

SEQ ID NO: 9411 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (2)..(3): 5-methyl
  misc_feature (6)..(6): 5-methyl
  misc_feature (9)..(9): 5-methyl
tccaacatcaaggaagatgg

SEQ ID NO: 9412 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (2)..(3): 5-methyl
  misc_feature (6)..(6): 5-methyl
  misc_feature (9)..(9): 5-methyl
tccaacatcaaggaagatg

SEQ ID NO: 9413 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (2)..(3): 5-methyl
  misc_feature (6)..(6): 5-methyl
  misc_feature (9)..(9): 5-methyl
tccaacatcaaggaagat

SEQ ID NO: 9414 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (2)..(3): 5-methyl
  misc_feature (6)..(6): 5-methyl
  misc_feature (9)..(9): 5-methyl
tccaacatcaaggaaga

SEQ ID NO: 9415 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (2)..(3): 5-methyl
  misc_feature (6)..(6): 5-methyl
  misc_feature (9)..(9): 5-methyl
tccaacatcaaggaag

SEQ ID NO: 9416 - DNA, 28 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(1): bicyclic nucleic acid (BNA)
  misc_feature (28)..(28): bicyclic nucleic acid (BNA)
ccaacatcaaggaagatggcatttctag

SEQ ID NO: 9417 - DNA, 27 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(1): bicyclic nucleic acid (BNA)
  misc_feature (27)..(27): bicyclic nucleic acid (BNA)
ccaacatcaaggaagatggcatttcta

SEQ ID NO: 9418 - DNA, 26 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(1): bicyclic nucleic acid (BNA)
  misc_feature (26)..(26): bicyclic nucleic acid (BNA)
ccaacatcaaggaagatggcatttct

SEQ ID NO: 9419 - DNA, 25 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(1): bicyclic nucleic acid (BNA)
  misc_feature (25)..(25): bicyclic nucleic acid (BNA)
ccaacatcaaggaagatggcatttc

SEQ ID NO: 9420 - DNA, 24 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
  misc_feature (24)..(24): bicyclic nucleic acid (BNA)
ccaacatcaaggaagatggcattt

SEQ ID NO: 9421 - DNA, 23 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
  misc_feature (23)..(23): bicyclic nucleic acid (BNA)
ccaacatcaaggaagatggcatt

SEQ ID NO: 9422 - DNA, 22 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
  misc_feature (22)..(22): bicyclic nucleic acid (BNA)
ccaacatcaaggaagatggcat

SEQ ID NO: 9423 - DNA, 21 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
  misc_feature (21)..(21): bicyclic nucleic acid (BNA)
ccaacatcaaggaagatggca

SEQ ID NO: 9424 - DNA, 20 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(1): bicyclic nucleic acid (BNA)
  misc_feature (20)..(20): bicyclic nucleic acid (BNA)
ccaacatcaaggaagatggc

SEQ ID NO: 9425 - DNA, 19 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
  misc_feature (19)..(19): bicyclic nucleic acid (BNA)
ccaacatcaaggaagatgg

SEQ ID NO: 9426 - DNA, 18 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
  misc_feature (18)..(18): bicyclic nucleic acid (BNA)
ccaacatcaaggaagatg

SEQ ID NO: 9427 - DNA, 17 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
  misc_feature (17)..(17): bicyclic nucleic acid (BNA)
ccaacatcaaggaagat

SEQ ID NO: 9428 - DNA, 16 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
  misc_feature (16)..(16): bicyclic nucleic acid (BNA)
ccaacatcaaggaaga

SEQ ID NO: 9429 - DNA, 15 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(1): bicyclic nucleic acid (BNA)
  misc_feature (15)..(15): bicyclic nucleic acid (BNA)
ccaacatcaaggaag

SEQ ID NO: 9430 - DNA, 27 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(1): bicyclic nucleic acid (BNA)
  misc_feature (27)..(27): bicyclic nucleic acid (BNA)
caacatcaaggaagatggcatttctag

SEQ ID NO: 9431 - DNA, 26 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(1): bicyclic nucleic acid (BNA)
  misc_feature (26)..(26): bicyclic nucleic acid (BNA)
caacatcaaggaagatggcatttcta

SEQ ID NO: 9432 - DNA, 25 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(1): bicyclic nucleic acid (BNA)
  misc_feature (25)..(25): bicyclic nucleic acid (BNA)
caacatcaaggaagatggcatttct

SEQ ID NO: 9433 - DNA, 24 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(1): bicyclic nucleic acid (BNA)
  misc_feature (24)..(24): bicyclic nucleic acid (BNA)
caacatcaaggaagatggcatttc

SEQ ID NO: 9434 - DNA, 23 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
  misc_feature (23)..(23): bicyclic nucleic acid (BNA)
caacatcaaggaagatggcattt

SEQ ID NO: 9435 - DNA, 22 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
  misc_feature (22)..(22): bicyclic nucleic acid (BNA)
caacatcaaggaagatggcatt

SEQ ID NO: 9436 - DNA, 21 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
  misc_feature (21)..(21): bicyclic nucleic acid (BNA)
caacatcaaggaagatggcat

SEQ ID NO: 9437 - DNA, 20 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
  misc_feature (20)..(20): bicyclic nucleic acid (BNA)
caacatcaaggaagatggca

SEQ ID NO: 9438 - DNA, 19 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(1): bicyclic nucleic acid (BNA)
  misc_feature (19)..(19): bicyclic nucleic acid (BNA)
caacatcaaggaagatggc

SEQ ID NO: 9439 - DNA, 18 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
  misc_feature (18)..(18): bicyclic nucleic acid (BNA)
caacatcaaggaagatgg

SEQ ID NO: 9440 - DNA, 17 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
  misc_feature (17)..(17): bicyclic nucleic acid (BNA)
caacatcaaggaagatg

SEQ ID NO: 9441 - DNA, 16 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
  misc_feature (16)..(16): bicyclic nucleic acid (BNA)
caacatcaaggaagat

SEQ ID NO: 9442 - DNA, 15 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
  misc_feature (15)..(15): bicyclic nucleic acid (BNA)
caacatcaaggaaga

SEQ ID NO: 9443 - DNA, 14 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(1): bicyclic nucleic acid (BNA)
  misc_feature (14)..(14): bicyclic nucleic acid (BNA)
caacatcaaggaag

SEQ ID NO: 9444 - DNA, 26 bp, Artificial Sequence
  Description of Artificial Sequence: Synthetic Antisense oligonucleotide
  misc_feature (1)..(1): bicyclic nucleic acid (BNA)
  misc_feature (26)..(26): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttctag

SEQ ID NO: 9445 - DNA, 25 bp, Artificial Sequence
  Description of Artificial Sequence: Synthetic Antisense oligonucleotide
  misc_feature (1)..(1): bicyclic nucleic acid (BNA)
  misc_feature (25)..(25): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttcta

SEQ ID NO: 9446 - DNA, 24 bp, Artificial Sequence
  Description of Artificial Sequence: Synthetic Antisense oligonucleotide
  misc_feature (1)..(1): bicyclic nucleic acid (BNA)
  misc_feature (24)..(24): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttct

SEQ ID NO: 9447 - DNA, 23 bp, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttc

SEQ ID NO: 9448 - DNA, 22 bp, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
  misc_feature (3)..(3): 5-methyl
  misc_feature (6)..(6): 5-methyl
  misc_feature (18)..(18): 5-methyl
aacatcaaggaagatggcattt

SEQ ID NO: 9449 - DNA, 21 bp, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
  misc_feature (3)..(3): 5-methyl
  misc_feature (6)..(6): 5-methyl
  misc_feature (18)..(18): 5-methyl
aacatcaaggaagatggcatt

SEQ ID NO: 9450 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (3)..(3): 5-methyl
  misc_feature (6)..(6): 5-methyl
  misc_feature (18)..(18): 5-methyl
aacatcaaggaagatggcat

SEQ ID NO: 9451 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (3)..(3): 5-methyl
  misc_feature (6)..(6): 5-methyl
  misc_feature (18)..(18): 5-methyl
aacatcaaggaagatggca

SEQ ID NO: 9452 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (3)..(3): 5-methyl
  misc_feature (6)..(6): 5-methyl
  misc_feature (18)..(18): 5-methyl
aacatcaaggaagatggc

SEQ ID NO: 9453 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (3)..(3): 5-methyl
  misc_feature (6)..(6): 5-methyl
aacatcaaggaagatgg

SEQ ID NO: 9454 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (3)..(3): 5-methyl
  misc_feature (6)..(6): 5-methyl
aacatcaaggaagatg

SEQ ID NO: 9455 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (3)..(3): 5-methyl
  misc_feature (6)..(6): 5-methyl
aacatcaaggaagat

SEQ ID NO: 9456 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (3)..(3): 5-methyl
  misc_feature (6)..(6): 5-methyl
aacatcaaggaaga

SEQ ID NO: 9457 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (3)..(3): 5-methyl
  misc_feature (6)..(6): 5-methyl
aacatcaaggaag

SEQ ID NO: 9458 - DNA, 25 bp, Artificial Sequence
  Description of Artificial Sequence: Synthetic Antisense oligonucleotide
  misc_feature (1)..(1): bicyclic nucleic acid (BNA)
  misc_feature (25)..(25): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttctag

SEQ ID NO: 9459 - DNA, 24 bp, Artificial Sequence
  Description of Artificial Sequence: Synthetic Antisense oligonucleotide
  misc_feature (1)..(1): bicyclic nucleic acid (BNA)
  misc_feature (24)..(24): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttcta

SEQ ID NO: 9460 - DNA, 23 bp, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttct

SEQ ID NO: 9461 - DNA, 22 bp, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttc

SEQ ID NO: 9462 - DNA, 21 bp, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
  misc_feature (2)..(2): 5-methyl
  misc_feature (5)..(5): 5-methyl
  misc_feature (17)..(17): 5-methyl
acatcaaggaagatggcattt

SEQ ID NO: 9463 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (2)..(2): 5-methyl
  misc_feature (5)..(5): 5-methyl
  misc_feature (17)..(17): 5-methyl
acatcaaggaagatggcatt

SEQ ID NO: 9464 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (2)..(2): 5-methyl
  misc_feature (5)..(5): 5-methyl
  misc_feature (17)..(17): 5-methyl
acatcaaggaagatggcat

SEQ ID NO: 9465 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (2)..(2): 5-methyl
  misc_feature (5)..(5): 5-methyl
  misc_feature (17)..(17): 5-methyl
acatcaaggaagatggca

SEQ ID NO: 9466 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (2)..(2): 5-methyl
  misc_feature (5)..(5): 5-methyl
  misc_feature (17)..(17): 5-methyl
acatcaaggaagatggc

SEQ ID NO: 9467 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (2)..(2): 5-methyl
  misc_feature (5)..(5): 5-methyl
acatcaaggaagatgg

SEQ ID NO: 9468 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (2)..(2): 5-methyl
  misc_feature (5)..(5): 5-methyl
acatcaaggaagatg

SEQ ID NO: 9469 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (2)..(2): 5-methyl
  misc_feature (5)..(5): 5-methyl
acatcaaggaagat

SEQ ID NO: 9470 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (2)..(2): 5-methyl
  misc_feature (5)..(5): 5-methyl
acatcaaggaaga

SEQ ID NO: 9471 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (2)..(2): 5-methyl
  misc_feature (5)..(5): 5-methyl
acatcaaggaag

SEQ ID NO: 9472 - DNA, 24 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(1): bicyclic nucleic acid (BNA)
  misc_feature (24)..(24): bicyclic nucleic acid (BNA)
catcaaggaagatggcatttctag

SEQ ID NO: 9473 - DNA, 23 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(1): bicyclic nucleic acid (BNA)
  misc_feature (23)..(23): bicyclic nucleic acid (BNA)
catcaaggaagatggcatttcta

SEQ ID NO: 9474 - DNA, 22 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(1): bicyclic nucleic acid (BNA)
  misc_feature (22)..(22): bicyclic nucleic acid (BNA)
catcaaggaagatggcatttct

SEQ ID NO: 9475 - DNA, 21 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(1): bicyclic nucleic acid (BNA)
  misc_feature (21)..(21): bicyclic nucleic acid (BNA)
catcaaggaagatggcatttc

SEQ ID NO: 9476 - DNA, 20 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
  misc_feature (20)..(20): bicyclic nucleic acid (BNA)
catcaaggaagatggcattt

SEQ ID NO: 9477 - DNA, 19 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
  misc_feature (19)..(19): bicyclic nucleic acid (BNA)
catcaaggaagatggcatt

SEQ ID NO: 9478 - DNA, 18 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
  misc_feature (18)..(18): bicyclic nucleic acid (BNA)
catcaaggaagatggcat

SEQ ID NO: 9479 - DNA, 17 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
  misc_feature (17)..(17): bicyclic nucleic acid (BNA)
catcaaggaagatggca

SEQ ID NO: 9480 - DNA, 16 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(1): bicyclic nucleic acid (BNA)
  misc_feature (16)..(16): bicyclic nucleic acid (BNA)
catcaaggaagatggc

SEQ ID NO: 9481 - DNA, 15 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
  misc_feature (15)..(15): bicyclic nucleic acid (BNA)
catcaaggaagatgg

SEQ ID NO: 9482 - DNA, 14 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
  misc_feature (14)..(14): bicyclic nucleic acid (BNA)
catcaaggaagatg

SEQ ID NO: 9483 - DNA, 13 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
  misc_feature (13)..(13): bicyclic nucleic acid (BNA)
catcaaggaagat

SEQ ID NO: 9484 - DNA, 12 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
  misc_feature (12)..(12): bicyclic nucleic acid (BNA)
catcaaggaaga

SEQ ID NO: 9485 - DNA, 11 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(1): bicyclic nucleic acid (BNA)
  misc_feature (11)..(11): bicyclic nucleic acid (BNA)
catcaaggaag

SEQ ID NO: 9486 - DNA, 23 bp, Artificial Sequence
  Description of Artificial Sequence: Synthetic Antisense oligonucleotide
  misc_feature (1)..(1): bicyclic nucleic acid (BNA)
  misc_feature (23)..(23): bicyclic nucleic acid (BNA)
  misc_feature (3)..(3): 5-methyl
  misc_feature (15)..(15): 5-methyl
  misc_feature (20)..(20): 5-methyl
atcaaggaagatggcatttctag

SEQ ID NO: 9487 - DNA, 22 bp, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
  misc_feature (3)..(3): 5-methyl
  misc_feature (15)..(15): 5-methyl
  misc_feature (20)..(20): 5-methyl
atcaaggaagatggcatttcta

SEQ ID NO: 9488 - DNA, 21 bp, Artificial Sequence
  Description of Artificial Sequence: Synthetic Antisense oligonucleotide
  misc_feature (1)..(1): bicyclic nucleic acid (BNA)
  misc_feature (21)..(21): bicyclic nucleic acid (BNA)
  misc_feature (3)..(3): 5-methyl
  misc_feature (15)..(15): 5-methyl
  misc_feature (20)..(20): 5-methyl
atcaaggaagatggcatttct

SEQ ID NO: 9489 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (3)..(3): 5-methyl
  misc_feature (15)..(15): 5-methyl
  misc_feature (20)..(20): 5-methyl
atcaaggaagatggcatttc

SEQ ID NO: 9490 - DNA, 19 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (3)..(3): 5-methyl
  misc_feature (15)..(15): 5-methyl
atcaaggaagatggcattt

SEQ ID NO: 9491 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (3)..(3): 5-methyl
  misc_feature (15)..(15): 5-methyl
atcaaggaagatggcatt

SEQ ID NO: 9492 - DNA, 17 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (3)..(3): 5-methyl
  misc_feature (15)..(15): 5-methyl
atcaaggaagatggcat

SEQ ID NO: 9493 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (3)..(3): 5-methyl
  misc_feature (15)..(15): 5-methyl
atcaaggaagatggca

SEQ ID NO: 9494 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (3)..(3): 5-methyl
  misc_feature (15)..(15): 5-methyl
atcaaggaagatggc

SEQ ID NO: 9495 - DNA, 14 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (3)..(3): 5-methyl
atcaaggaagatgg

SEQ ID NO: 9496 - DNA, 13 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (3)..(3): 5-methyl
atcaaggaagatg

SEQ ID NO: 9497 - DNA, 12 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (3)..(3): 5-methyl
atcaaggaagat

SEQ ID NO: 9498 - DNA, 11 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (3)..(3): 5-methyl
atcaaggaaga

SEQ ID NO: 9499 - DNA, 10 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (3)..(3): 5-methyl
atcaaggaag

SEQ ID NO: 9500 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 9501 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 9502 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 9503 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
ctgtccaagcccggttga

SEQ ID NO: 9504 - DNA, 15 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (11)..(12): 5-methyl
taagttctgtccaag

SEQ ID NO: 9505 - DNA, 20 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(14): 5-methyl
ttctgtccaagcccggttga

SEQ ID NO: 9506 - DNA, 19 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(14): 5-methyl
ttctgtccaagcccggttg

SEQ ID NO: 9507 - DNA, 18 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(14): 5-methyl
ttctgtccaagcccggtt

SEQ ID NO: 9508 - DNA, 17 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(14): 5-methyl
ttctgtccaagcccggt

SEQ ID NO: 9509 - DNA, 16 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(14): 5-methyl
ttctgtccaagcccgg

SEQ ID NO: 9510 - DNA, 15 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(14): 5-methyl
ttctgtccaagcccg

SEQ ID NO: 9511 - DNA, 14 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(14): 5-methyl
ttctgtccaagccc

SEQ ID NO: 9512 - DNA, 13 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(13): 5-methyl
ttctgtccaagcc

SEQ ID NO: 9513 - DNA, 12 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (7)..(8): 5-methyl
  misc_feature (12)..(12): 5-methyl
ttctgtccaagc

SEQ ID NO: 9514 - DNA, 11 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (7)..(8): 5-methyl
ttctgtccaag

SEQ ID NO: 9515 - DNA, 10 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (7)..(8): 5-methyl
ttctgtccaa

SEQ ID NO: 9516 - DNA, 9 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (7)..(8): 5-methyl
ttctgtcca

SEQ ID NO: 9517 - DNA, 8 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (7)..(8): 5-methyl
ttctgtcc

SEQ ID NO: 9518 - DNA, 19 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(13): 5-methyl
tctgtccaagcccggttga

SEQ ID NO: 9519 - DNA, 18 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(13): 5-methyl
tctgtccaagcccggttg

SEQ ID NO: 9520 - DNA, 17 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(13): 5-methyl
tctgtccaagcccggtt

SEQ ID NO: 9521 - DNA, 16 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(13): 5-methyl
tctgtccaagcccggt

SEQ ID NO: 9522 - DNA, 15 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(13): 5-methyl
tctgtccaagcccgg

SEQ ID NO: 9523 - DNA, 14 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(13): 5-methyl
tctgtccaagcccg

SEQ ID NO: 9524 - DNA, 13 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(13): 5-methyl
tctgtccaagccc

SEQ ID NO: 9525 - DNA, 12 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(12): 5-methyl
tctgtccaagcc

SEQ ID NO: 9526 - DNA, 11 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (6)..(7): 5-methyl
  misc_feature (11)..(11): 5-methyl
tctgtccaagc

SEQ ID NO: 9527 - DNA, 10 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (6)..(7): 5-methyl
tctgtccaag

SEQ ID NO: 9528 - DNA, 9 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (6)..(7): 5-methyl
tctgtccaa

SEQ ID NO: 9529 - DNA, 8 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (6)..(7): 5-methyl
tctgtcca

SEQ ID NO: 9530 - DNA, 17 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
ctgtccaagcccggttg

SEQ ID NO: 9531 - DNA, 16 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
ctgtccaagcccggtt

SEQ ID NO: 9532 - DNA, 15 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
ctgtccaagcccggt

SEQ ID NO: 9533 - DNA, 14 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
ctgtccaagcccgg

SEQ ID NO: 9534 - DNA, 13 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
ctgtccaagcccg

SEQ ID NO: 9535 - DNA, 12 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
ctgtccaagccc

SEQ ID NO: 9536 - DNA, 11 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(11): 5-methyl
  misc_feature (1)..(2): bicyclic nucleic acid (BNA)
ctgtccaagcc

SEQ ID NO: 9537 - DNA, 10 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(10): 5-methyl
  misc_feature (1)..(2): bicyclic nucleic acid (BNA)
ctgtccaagc

SEQ ID NO: 9538 - DNA, 9 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (1)..(2): bicyclic nucleic acid (BNA)
ctgtccaag

SEQ ID NO: 9539 - DNA, 8 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (1)..(2): bicyclic nucleic acid (BNA)
ctgtccaa

SEQ ID NO: 9540 - DNA, 20 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (8)..(9): 5-methyl
  misc_feature (13)..(15): 5-methyl
gttctgtccaagcccggttg

SEQ ID NO: 9541 - DNA, 19 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (8)..(9): 5-methyl
  misc_feature (13)..(15): 5-methyl
gttctgtccaagcccggtt

SEQ ID NO: 9542 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (8)..(9): 5-methyl
  misc_feature (13)..(15): 5-methyl
gttctgtccaagcccggt

SEQ ID NO: 9543 - DNA, 17 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (8)..(9): 5-methyl
  misc_feature (13)..(15): 5-methyl
gttctgtccaagcccgg

SEQ ID NO: 9544 - DNA, 16 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (8)..(9): 5-methyl
  misc_feature (13)..(15): 5-methyl
gttctgtccaagcccg

SEQ ID NO: 9545 - DNA, 15 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (8)..(9): 5-methyl
  misc_feature (13)..(15): 5-methyl
gttctgtccaagccc

SEQ ID NO: 9546 - DNA, 14 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (8)..(9): 5-methyl
  misc_feature (13)..(14): 5-methyl
gttctgtccaagcc

SEQ ID NO: 9547 - DNA, 13 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (8)..(9): 5-methyl
  misc_feature (13)..(13): 5-methyl
gttctgtccaagc

SEQ ID NO: 9548 - DNA, 12 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (8)..(9): 5-methyl
gttctgtccaag

SEQ ID NO: 9549 - DNA, 11 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (8)..(9): 5-methyl
gttctgtccaa

SEQ ID NO: 9550 - DNA, 10 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (8)..(9): 5-methyl
gttctgtcca

SEQ ID NO: 9551 - DNA, 9 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (8)..(9): 5-methyl
gttctgtcc

SEQ ID NO: 9552 - DNA, 8 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (8)..(8): 5-methyl
gttctgtc

SEQ ID NO: 9553 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
  misc_feature (14)..(16): 5-methyl
agttctgtccaagcccggtt

SEQ ID NO: 9554 - DNA, 19 bp, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
  misc_feature (14)..(16): 5-methyl
agttctgtccaagcccggt

SEQ ID NO: 9555 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
  misc_feature (14)..(16): 5-methyl
agttctgtccaagcccgg

SEQ ID NO: 9556 - DNA, 17 bp, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
  misc_feature (14)..(16): 5-methyl
agttctgtccaagcccg

SEQ ID NO: 9557 - DNA, 16 bp, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
  misc_feature (14)..(16): 5-methyl
agttctgtccaagccc

SEQ ID NO: 9558 - DNA, 15 bp, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
  misc_feature (14)..(15): 5-methyl
agttctgtccaagcc

SEQ ID NO: 9559 - DNA, 14 bp, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
  misc_feature (14)..(14): 5-methyl
agttctgtccaagc

SEQ ID NO: 9560 - DNA, 13 bp, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
agttctgtccaag

SEQ ID NO: 9561 - DNA, 12 bp, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
agttctgtccaa

SEQ ID NO: 9562 - DNA, 11 bp, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
agttctgtcca

SEQ ID NO: 9563 - DNA, 10 bp, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(10): 5-methyl
agttctgtcc

SEQ ID NO: 9564 - DNA, 9 bp, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
  misc_feature (9)..(9): 5-methyl
agttctgtc

SEQ ID NO: 9565 - DNA, 8 bp, Artificial Sequence
  Description of Artificial Sequence: Synthetic Antisense oligonucleotide
  misc_feature (1)..(2): bicyclic nucleic acid (BNA)
  misc_feature (5)..(5): 5-methyl
agttctgt

SEQ ID NO: 9566 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
  misc_feature (15)..(17): 5-methyl
aagttctgtccaagcccggt

SEQ ID NO: 9567 - DNA, 19 bp, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
  misc_feature (15)..(17): 5-methyl
aagttctgtccaagcccgg

SEQ ID NO: 9568 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
  misc_feature (15)..(17): 5-methyl
aagttctgtccaagcccg

SEQ ID NO: 9569 - DNA, 17 bp, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
  misc_feature (15)..(17): 5-methyl
aagttctgtccaagccc

SEQ ID NO: 9570 - DNA, 16 bp, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
  misc_feature (15)..(16): 5-methyl
aagttctgtccaagcc

SEQ ID NO: 9571 - DNA, 15 bp, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
  misc_feature (15)..(15): 5-methyl
aagttctgtccaagc

SEQ ID NO: 9572 - DNA, 14 bp, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
aagttctgtccaag

SEQ ID NO: 9573 - DNA, 13 bp, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
aagttctgtccaa

SEQ ID NO: 9574 - DNA, 12 bp, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
aagttctgtcca

SEQ ID NO: 9575 - DNA, 11 bp, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(11): 5-methyl
aagttctgtcc

SEQ ID NO: 9576 - DNA, 10 bp, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
  misc_feature (10)..(10): 5-methyl
aagttctgtc

SEQ ID NO: 9577 - DNA, 9 bp, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
aagttctgt

SEQ ID NO: 9578 - DNA, 8 bp, Artificial Sequence
  Description of Artificial Sequence: Synthetic Antisense oligonucleotide
  misc_feature (1)..(2): bicyclic nucleic acid (BNA)
  misc_feature (6)..(6): 5-methyl
aagttctg

SEQ ID NO: 9579 - DNA, 20 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (11)..(12): 5-methyl
  misc_feature (16)..(18): 5-methyl
taagttctgtccaagcccgg

SEQ ID NO: 9580 - DNA, 19 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (11)..(12): 5-methyl
  misc_feature (16)..(18): 5-methyl
taagttctgtccaagcccg

SEQ ID NO: 9581 - DNA, 18 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (11)..(12): 5-methyl
  misc_feature (16)..(18): 5-methyl
taagttctgtccaagccc

SEQ ID NO: 9582 - DNA, 17 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (11)..(12): 5-methyl
  misc_feature (16)..(17): 5-methyl
taagttctgtccaagcc

SEQ ID NO: 9583 - DNA, 16 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (11)..(12): 5-methyl
  misc_feature (16)..(16): 5-methyl
taagttctgtccaagc

SEQ ID NO: 9584 - DNA, 14 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (11)..(12): 5-methyl
taagttctgtccaa

SEQ ID NO: 9585 - DNA, 13 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (11)..(12): 5-methyl
taagttctgtcca

SEQ ID NO: 9586 - DNA, 12 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (11)..(12): 5-methyl
taagttctgtcc

SEQ ID NO: 9587 - DNA, 11 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (11)..(11): 5-methyl
taagttctgtc

SEQ ID NO: 9588 - DNA, 10 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
taagttctgt

SEQ ID NO: 9589 - DNA, 9 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
taagttctg

SEQ ID NO: 9590 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
taagttct

SEQ ID NO: 9591 - DNA, 20 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
  misc_feature (12)..(13): 5-methyl
  misc_feature (17)..(19): 5-methyl
gtaagttctgtccaagcccg

SEQ ID NO: 9592 - DNA, 19 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
  misc_feature (12)..(13): 5-methyl
  misc_feature (17)..(19): 5-methyl
gtaagttctgtccaagccc

SEQ ID NO: 9593 - DNA, 17 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
  misc_feature (12)..(13): 5-methyl
  misc_feature (17)..(17): 5-methyl
gtaagttctgtccaagc

SEQ ID NO: 9594 - DNA, 16 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
  misc_feature (12)..(13): 5-methyl
gtaagttctgtccaag

SEQ ID NO: 9595 - DNA, 15 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
  misc_feature (12)..(13): 5-methyl
gtaagttctgtccaa

SEQ ID NO: 9596 - DNA, 14 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
  misc_feature (12)..(13): 5-methyl
gtaagttctgtcca

SEQ ID NO: 9597 - DNA, 13 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
  misc_feature (12)..(13): 5-methyl
gtaagttctgtcc

SEQ ID NO: 9598 - DNA, 12 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
  misc_feature (12)..(12): 5-methyl
gtaagttctgtc

SEQ ID NO: 9599 - DNA, 11 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
gtaagttctgt

SEQ ID NO: 9600 - DNA, 10 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
gtaagttctg

SEQ ID NO: 9601 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
gtaagttct

SEQ ID NO: 9602 - DNA, 8 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
gtaagttc

SEQ ID NO: 9603 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (13)..(14): 5-methyl
  misc_feature (18)..(20): 5-methyl
ggtaagttctgtccaagccc

SEQ ID NO: 9604 - DNA, 19 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (13)..(14): 5-methyl
  misc_feature (18)..(19): 5-methyl
ggtaagttctgtccaagcc

SEQ ID NO: 9605 - DNA, 17 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (13)..(14): 5-methyl
ggtaagttctgtccaag

SEQ ID NO: 9606 - DNA, 16 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (13)..(14): 5-methyl
ggtaagttctgtccaa

SEQ ID NO: 9607 - DNA, 15 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (13)..(14): 5-methyl
ggtaagttctgtcca

SEQ ID NO: 9608 - DNA, 14 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (13)..(14): 5-methyl
ggtaagttctgtcc

SEQ ID NO: 9609 - DNA, 13 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (13)..(13): 5-methyl
ggtaagttctgtc

SEQ ID NO: 9610 - DNA, 12 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
ggtaagttctgt

SEQ ID NO: 9611 - DNA, 11 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
ggtaagttctg

SEQ ID NO: 9612 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
ggtaagttct

SEQ ID NO: 9613 - DNA, 9 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
ggtaagttc

SEQ ID NO: 9614 - DNA, 20 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(20): 5-methyl
  misc_feature (1)..(2): bicyclic nucleic acid (BNA)
cggtaagttctgtccaagcc

SEQ ID NO: 9615 - DNA, 19 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(19): 5-methyl
  misc_feature (1)..(2): bicyclic nucleic acid (BNA)
cggtaagttctgtccaagc

SEQ ID NO: 9616 - DNA, 18 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(2): bicyclic nucleic acid (BNA)
cggtaagttctgtccaag

SEQ ID NO: 9617 - DNA, 17 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(2): bicyclic nucleic acid (BNA)
cggtaagttctgtccaa

SEQ ID NO: 9618 - DNA, 16 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(2): bicyclic nucleic acid (BNA)
cggtaagttctgtcca

SEQ ID NO: 9619 - DNA, 15 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(2): bicyclic nucleic acid (BNA)
cggtaagttctgtcc

SEQ ID NO: 9620 - DNA, 14 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(14): 5-methyl
  misc_feature (1)..(2): bicyclic nucleic acid (BNA)
cggtaagttctgtc

SEQ ID NO: 9621 - DNA, 13 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(2): bicyclic nucleic acid (BNA)
cggtaagttctgt

SEQ ID NO: 9622 - DNA, 12 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(2): bicyclic nucleic acid (BNA)
cggtaagttctg

SEQ ID NO: 9623 - DNA, 11 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(2): bicyclic nucleic acid (BNA)
cggtaagttct

SEQ ID NO: 9624 - DNA, 10 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(2): bicyclic nucleic acid (BNA)
cggtaagttc

SEQ ID NO: 9625 - DNA, 9 bp, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
cggtaagtt

SEQ ID NO: 9626 - DNA, 8 bp, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
cggtaagt

SEQ ID NO: 9627 - DNA, 20 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (11)..(11): 5-methyl
  misc_feature (15)..(16): 5-methyl
  misc_feature (20)..(20): 5-methyl
tcggtaagttctgtccaagc

SEQ ID NO: 9628 - DNA, 19 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (11)..(11): 5-methyl
  misc_feature (15)..(16): 5-methyl
tcggtaagttctgtccaag

SEQ ID NO: 9629 - DNA, 18 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (11)..(11): 5-methyl
  misc_feature (15)..(16): 5-methyl
tcggtaagttctgtccaa

SEQ ID NO: 9630 - DNA, 17 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (11)..(11): 5-methyl
  misc_feature (15)..(16): 5-methyl
tcggtaagttctgtcca

SEQ ID NO: 9631 - DNA, 16 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (11)..(11): 5-methyl
  misc_feature (15)..(16): 5-methyl
tcggtaagttctgtcc

SEQ ID NO: 9632 - DNA, 15 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (11)..(11): 5-methyl
  misc_feature (15)..(15): 5-methyl
tcggtaagttctgtc

SEQ ID NO: 9633 - DNA, 14 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (11)..(11): 5-methyl
tcggtaagttctgt

SEQ ID NO: 9634 - DNA, 13 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (11)..(11): 5-methyl
tcggtaagttctg

SEQ ID NO: 9635 - DNA, 12 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (11)..(11): 5-methyl
tcggtaagttct

SEQ ID NO: 9636 - DNA, 11 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (11)..(11): 5-methyl
tcggtaagttc

SEQ ID NO: 9637 - DNA, 10 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
tcggtaagtt

SEQ ID NO: 9638 - DNA, 9 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
tcggtaagt

SEQ ID NO: 9639 - DNA, 20 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (12)..(12): 5-methyl
  misc_feature (16)..(17): 5-methyl
gtcggtaagttctgtccaag

SEQ ID NO: 9640 - DNA, 19 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (12)..(12): 5-methyl
  misc_feature (16)..(17): 5-methyl
gtcggtaagttctgtccaa

SEQ ID NO: 9641 - DNA, 18 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (12)..(12): 5-methyl
  misc_feature (16)..(17): 5-methyl
gtcggtaagttctgtcca

SEQ ID NO: 9642 - DNA, 17 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (12)..(12): 5-methyl
  misc_feature (16)..(17): 5-methyl
gtcggtaagttctgtcc

SEQ ID NO: 9643 - DNA, 16 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (12)..(12): 5-methyl
  misc_feature (16)..(16): 5-methyl
gtcggtaagttctgtc

SEQ ID NO: 9644 - DNA, 15 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (12)..(12): 5-methyl
gtcggtaagttctgt

SEQ ID NO: 9645 - DNA, 14 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (12)..(12): 5-methyl
gtcggtaagttctg

SEQ ID NO: 9646 - DNA, 13 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (12)..(12): 5-methyl
gtcggtaagttct

SEQ ID NO: 9647 - DNA, 12 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (12)..(12): 5-methyl
gtcggtaagttc

SEQ ID NO: 9648 - DNA, 11 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
gtcggtaagtt

SEQ ID NO: 9649 - DNA, 10 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
gtcggtaagt

SEQ ID NO: 9650 - DNA, 20 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (13)..(13): 5-methyl
  misc_feature (17)..(18): 5-methyl
agtcggtaagttctgtccaa

SEQ ID NO: 9651 - DNA, 19 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcca

SEQ ID NO: 9652 - DNA, 17 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (13)..(13): 5-methyl
  misc_feature (17)..(17): 5-methyl
agtcggtaagttctgtc

SEQ ID NO: 9653 - DNA, 16 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (13)..(13): 5-methyl
agtcggtaagttctgt

SEQ ID NO: 9654 - DNA, 15 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (13)..(13): 5-methyl
agtcggtaagttctg

SEQ ID NO: 9655 - DNA, 14 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (13)..(13): 5-methyl
agtcggtaagttct

SEQ ID NO: 9656 - DNA, 13 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
  misc_feature (13)..(13): 5-methyl
agtcggtaagttc

SEQ ID NO: 9657 - DNA, 12 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
agtcggtaagtt

SEQ ID NO: 9658 - DNA, 11 bp, Artificial Sequence
  Description of Artificial Sequence: Synthetic Antisense oligonucleotide
  misc_feature (1)..(2): bicyclic nucleic acid (BNA)
  misc_feature (4)..(4): 5-methyl
agtcggtaagt

SEQ ID NO: 9659 - DNA, 20 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (1)..(2): bicyclic nucleic acid (BNA)
cagtcggtaagttctgtcca

SEQ ID NO: 9660 - DNA, 19 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (1)..(2): bicyclic nucleic acid (BNA)
cagtcggtaagttctgtcc

SEQ ID NO: 9661 - DNA, 18 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(18): 5-methyl
  misc_feature (1)..(2): bicyclic nucleic acid (BNA)
cagtcggtaagttctgtc

SEQ ID NO: 9662 - DNA, 17 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(2): bicyclic nucleic acid (BNA)
cagtcggtaagttctgt

SEQ ID NO: 9663 - DNA, 16 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(2): bicyclic nucleic acid (BNA)
cagtcggtaagttctg

SEQ ID NO: 9664 - DNA, 15 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(2): bicyclic nucleic acid (BNA)
cagtcggtaagttct

SEQ ID NO: 9665 - DNA, 14 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(2): bicyclic nucleic acid (BNA)
cagtcggtaagttc

SEQ ID NO: 9666 - DNA, 13 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (1)..(2): bicyclic nucleic acid (BNA)
cagtcggtaagtt

SEQ ID NO: 9667 - DNA, 12 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (1)..(2): bicyclic nucleic acid (BNA)
cagtcggtaagt

SEQ ID NO: 9668 - DNA, 20 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(20): 5-methyl
  misc_feature (1)..(2): bicyclic nucleic acid (BNA)
ccagtcggtaagttctgtcc

SEQ ID NO: 9669 - DNA, 19 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(19): 5-methyl
  misc_feature (1)..(2): bicyclic nucleic acid (BNA)
ccagtcggtaagttctgtc

SEQ ID NO: 9670 - DNA, 18 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(2): bicyclic nucleic acid (BNA)
ccagtcggtaagttctgt

SEQ ID NO: 9671 - DNA, 17 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(2): bicyclic nucleic acid (BNA)
ccagtcggtaagttctg

SEQ ID NO: 9672 - DNA, 16 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(2): bicyclic nucleic acid (BNA)
ccagtcggtaagttct

SEQ ID NO: 9673 - DNA, 15 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(2): bicyclic nucleic acid (BNA)
ccagtcggtaagttc

SEQ ID NO: 9674 - DNA, 14 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (1)..(2): bicyclic nucleic acid (BNA)
ccagtcggtaagtt

SEQ ID NO: 9675 - DNA, 13 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (1)..(2): bicyclic nucleic acid (BNA)
ccagtcggtaagt

SEQ ID NO: 9676 - DNA, 20 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (7)..(7): 5-methyl
  misc_feature (16)..(16): 5-methyl
  misc_feature (20)..(20): 5-methyl
gccagtcggtaagttctgtc

SEQ ID NO: 9677 - DNA, 19 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (7)..(7): 5-methyl
  misc_feature (16)..(16): 5-methyl
gccagtcggtaagttctgt

SEQ ID NO: 9678 - DNA, 18 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (7)..(7): 5-methyl
  misc_feature (16)..(16): 5-methyl
gccagtcggtaagttctg

SEQ ID NO: 9679 - DNA, 17 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (7)..(7): 5-methyl
  misc_feature (16)..(16): 5-methyl
gccagtcggtaagttct

SEQ ID NO: 9680 - DNA, 16 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (7)..(7): 5-methyl
  misc_feature (16)..(16): 5-methyl
gccagtcggtaagttc

SEQ ID NO: 9681 - DNA, 15 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (7)..(7): 5-methyl
gccagtcggtaagtt

SEQ ID NO: 9682 - DNA, 14 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (7)..(7): 5-methyl
gccagtcggtaagt

SEQ ID NO: 9683 - DNA, 20 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 9684 - DNA, 22 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 9685 - DNA, 16 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (14)..(14): 5-methyl
tcaaggaagatggcat

SEQ ID NO: 9686 - DNA, 15 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (14)..(14): 5-methyl
gaagatggcatttct

SEQ ID NO: 9687 - DNA, 21 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttcta

SEQ ID NO: 9688 - DNA, 19 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttc

SEQ ID NO: 9689 - DNA, 18 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (14)..(14): 5-methyl
tcaaggaagatggcattt

SEQ ID NO: 9690 - DNA, 17 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (14)..(14): 5-methyl
tcaaggaagatggcatt

SEQ ID NO: 9691 - DNA, 15 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (14)..(14): 5-methyl
tcaaggaagatggca

SEQ ID NO: 9692 - DNA, 14 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (14)..(14): 5-methyl
tcaaggaagatggc

SEQ ID NO: 9693 - DNA, 13 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
tcaaggaagatgg

SEQ ID NO: 9694 - DNA, 12 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
tcaaggaagatg

SEQ ID NO: 9695 - DNA, 11 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
tcaaggaagat

SEQ ID NO: 9696 - DNA, 10 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
tcaaggaaga

SEQ ID NO: 9697 - DNA, 9 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
tcaaggaag

SEQ ID NO: 9698 - DNA, 21 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(2): bicyclic nucleic acid (BNA)
caaggaagatggcatttctag

SEQ ID NO: 9699 - DNA, 20 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(2): bicyclic nucleic acid (BNA)
caaggaagatggcatttcta

SEQ ID NO: 9700 - DNA, 19 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(2): bicyclic nucleic acid (BNA)
caaggaagatggcatttct

SEQ ID NO: 9701 - DNA, 18 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(2): bicyclic nucleic acid (BNA)
caaggaagatggcatttc

SEQ ID NO: 9702 - DNA, 17 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(2): bicyclic nucleic acid (BNA)
caaggaagatggcattt

SEQ ID NO: 9703 - DNA, 16 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(2): bicyclic nucleic acid (BNA)
caaggaagatggcatt

SEQ ID NO: 9704 - DNA, 15 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(2): bicyclic nucleic acid (BNA)
caaggaagatggcat

SEQ ID NO: 9705 - DNA, 14 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(2): bicyclic nucleic acid (BNA)
caaggaagatggca

SEQ ID NO: 9706 - DNA, 13 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(2): bicyclic nucleic acid (BNA)
caaggaagatggc

SEQ ID NO: 9707 - DNA, 12 bp, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
caaggaagatgg

SEQ ID NO: 9708 - DNA, 11 bp, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
caaggaagatg

SEQ ID NO: 9709 - DNA, 10 bp, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
caaggaagat

SEQ ID NO: 9710 - DNA, 20 bp, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
  misc_feature (17)..(17): 5-methyl
aaggaagatggcatttctag

SEQ ID NO: 9711 - DNA, 19 bp, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
  misc_feature (17)..(17): 5-methyl
aaggaagatggcatttcta

SEQ ID NO: 9712 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
  misc_feature (17)..(17): 5-methyl
aaggaagatggcatttct

SEQ ID NO: 9713 - DNA, 17 bp, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
  misc_feature (17)..(17): 5-methyl
aaggaagatggcatttc

SEQ ID NO: 9714 - DNA, 16 bp, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
aaggaagatggcattt

SEQ ID NO: 9715 - DNA, 15 bp, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
aaggaagatggcatt

SEQ ID NO: 9716 - DNA, 14 bp, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
aaggaagatggcat

SEQ ID NO: 9717 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
aaggaagatggca

SEQ ID NO: 9718 - DNA, 12 bp, Artificial Sequence
  Description of Artificial Sequence: Synthetic Antisense oligonucleotide
  misc_feature (1)..(2): bicyclic nucleic acid (BNA)
  misc_feature (12)..(12): 5-methyl
aaggaagatggc

SEQ ID NO: 9719 - DNA, 19 bp, Artificial Sequence
  Description of Artificial Sequence: Synthetic Antisense oligonucleotide
  misc_feature (1)..(2): bicyclic nucleic acid (BNA)
  misc_feature (11)..(11): 5-methyl
  misc_feature (16)..(16): 5-methyl
aggaagatggcatttctag

SEQ ID NO: 9720 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): 5-methyl
  misc_feature (16)..(16): 5-methyl
aggaagatggcatttcta

SEQ ID NO: 9721 - DNA, 17 bp, Artificial Sequence
  Description of Artificial Sequence: Synthetic Antisense oligonucleotide
  misc_feature (1)..(2): bicyclic nucleic acid (BNA)
  misc_feature (11)..(11): 5-methyl
  misc_feature (16)..(16): 5-methyl
aggaagatggcatttct

SEQ ID NO: 9722 - DNA, 16 bp, Artificial Sequence
  Description of Artificial Sequence: Synthetic Antisense oligonucleotide
  misc_feature (1)..(2): bicyclic nucleic acid (BNA)
  misc_feature (11)..(11): 5-methyl
  misc_feature (16)..(16): 5-methyl
aggaagatggcatttc

SEQ ID NO: 9723 - DNA, 15 bp, Artificial Sequence
  Description of Artificial Sequence: Synthetic Antisense oligonucleotide
  misc_feature (1)..(2): bicyclic nucleic acid (BNA)
  misc_feature (11)..(11): 5-methyl
aggaagatggcattt

SEQ ID NO: 9724 - DNA, 14 bp, Artificial Sequence
  Description of Artificial Sequence: Synthetic Antisense oligonucleotide
  misc_feature (1)..(2): bicyclic nucleic acid (BNA)
  misc_feature (11)..(11): 5-methyl
aggaagatggcatt

SEQ ID NO: 9725 - DNA, 13 bp, Artificial Sequence
  Description of Artificial Sequence: Synthetic Antisense oligonucleotide
  misc_feature (1)..(2): bicyclic nucleic acid (BNA)
  misc_feature (11)..(11): 5-methyl
aggaagatggcat

SEQ ID NO: 9726 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(11): 5-methyl
aggaagatggca

SEQ ID NO: 9727 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
  misc_feature (15)..(15): 5-methyl
ggaagatggcatttctag

SEQ ID NO: 9728 - DNA, 17 bp, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
  misc_feature (15)..(15): 5-methyl
ggaagatggcatttcta

SEQ ID NO: 9729 - DNA, 16 bp, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
  misc_feature (15)..(15): 5-methyl
ggaagatggcatttct

SEQ ID NO: 9730 - DNA, 15 bp, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
  misc_feature (15)..(15): 5-methyl
ggaagatggcatttc

SEQ ID NO: 9731 - DNA, 14 bp, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
ggaagatggcattt

SEQ ID NO: 9732 - DNA, 13 bp, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
ggaagatggcatt

SEQ ID NO: 9733 - DNA, 12 bp, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
ggaagatggcat

SEQ ID NO: 9734 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
ggaagatggca

SEQ ID NO: 9735 - DNA, 10 bp, Artificial Sequence
  Description of Artificial Sequence: Synthetic Antisense oligonucleotide
  misc_feature (1)..(2): bicyclic nucleic acid (BNA)
  misc_feature (10)..(10): 5-methyl
ggaagatggc

SEQ ID NO: 9736 - DNA, 17 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (14)..(14): 5-methyl
gaagatggcatttctag

SEQ ID NO: 9737 - DNA, 16 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (14)..(14): 5-methyl
gaagatggcatttcta

SEQ ID NO: 9738 - DNA, 14 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
  misc_feature (14)..(14): 5-methyl
gaagatggcatttc

SEQ ID NO: 9739 - DNA, 13 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
gaagatggcattt

SEQ ID NO: 9740 - DNA, 12 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
gaagatggcatt

SEQ ID NO: 9741 - DNA, 11 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
gaagatggcat

SEQ ID NO: 9742 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
gaagatggca

SEQ ID NO: 9743 - DNA, 9 bp, Artificial Sequence
  Description of Artificial Sequence: Synthetic Antisense oligonucleotide
  misc_feature (1)..(2): bicyclic nucleic acid (BNA)
  misc_feature (9)..(9): 5-methyl
gaagatggc

SEQ ID NO: 9744 - DNA, 16 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
  misc_feature (13)..(13): 5-methyl
aagatggcatttctag

SEQ ID NO: 9745 - DNA, 15 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
  misc_feature (13)..(13): 5-methyl
aagatggcatttcta

SEQ ID NO: 9746 - DNA, 14 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
  misc_feature (13)..(13): 5-methyl
aagatggcatttct

SEQ ID NO: 9747 - DNA, 13 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
  misc_feature (13)..(13): 5-methyl
aagatggcatttc

SEQ ID NO: 9748 - DNA, 12 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
aagatggcattt

SEQ ID NO: 9749 - DNA, 11 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
aagatggcatt

SEQ ID NO: 9750 - DNA, 10 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
aagatggcat

SEQ ID NO: 9751 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
aagatggca

SEQ ID NO: 9752 - DNA, 8 bp, Artificial Sequence
  Description of Artificial Sequence: Synthetic Antisense oligonucleotide
  misc_feature (1)..(2): bicyclic nucleic acid (BNA)
  misc_feature (8)..(8): 5-methyl
aagatggc

SEQ ID NO: 9753 - DNA, 15 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (12)..(12): 5-methyl
agatggcatttctag

SEQ ID NO: 9754 - DNA, 14 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (12)..(12): 5-methyl
agatggcatttcta

SEQ ID NO: 9755 - DNA, 13 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (12)..(12): 5-methyl
agatggcatttct

SEQ ID NO: 9756 - DNA, 12 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
  misc_feature (12)..(12): 5-methyl
agatggcatttc

SEQ ID NO: 9757 - DNA, 11 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
agatggcattt

SEQ ID NO: 9758 - DNA, 10 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
agatggcatt

SEQ ID NO: 9759 - DNA, 9 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
agatggcat

SEQ ID NO: 9760 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(7): 5-methyl
agatggca

SEQ ID NO: 9761 - DNA, 30 bp, Artificial Sequence; identical to SEQ ID NO: 8
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(2): bicyclic nucleic acid (BNA)

SEQ ID NO: 9762 - DNA, 29 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(2): bicyclic nucleic acid (BNA)
ctccaacatcaaggaagatggcatttcta

SEQ ID NO: 9763 - DNA, 28 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(2): bicyclic nucleic acid (BNA)
ctccaacatcaaggaagatggcatttct

SEQ ID NO: 9764 - DNA, 27 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(2): bicyclic nucleic acid (BNA)
ctccaacatcaaggaagatggcatttc

SEQ ID NO: 9765 - DNA, 26 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
ctccaacatcaaggaagatggcattt

SEQ ID NO: 9766 - DNA, 25 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
ctccaacatcaaggaagatggcatt

SEQ ID NO: 9767 - DNA, 24 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
ctccaacatcaaggaagatggcat

SEQ ID NO: 9768 - DNA, 23 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
ctccaacatcaaggaagatggca

SEQ ID NO: 9769 - DNA, 22 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
ctccaacatcaaggaagatggc

SEQ ID NO: 9770 - DNA, 21 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
ctccaacatcaaggaagatgg

SEQ ID NO: 9771 - DNA, 20 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
ctccaacatcaaggaagatg

SEQ ID NO: 9772 - DNA, 19 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
ctccaacatcaaggaagat

SEQ ID NO: 9773 - DNA, 18 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
ctccaacatcaaggaaga

SEQ ID NO: 9774 - DNA, 17 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
ctccaacatcaaggaag

SEQ ID NO: 9775 - DNA, 29 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttctag

SEQ ID NO: 9776 - DNA, 28 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttcta

SEQ ID NO: 9777 - DNA, 27 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttct

SEQ ID NO: 9778 - DNA, 26 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttc

SEQ ID NO: 9779 - DNA, 25 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggcattt

SEQ ID NO: 9780 - DNA, 24 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggcatt

SEQ ID NO: 9781 - DNA, 23 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggcat

SEQ ID NO: 9782 - DNA, 22 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggca

SEQ ID NO: 9783 - DNA, 21 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggc

SEQ ID NO: 9784 - DNA, 20 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
tccaacatcaaggaagatgg

SEQ ID NO: 9785 - DNA, 19 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
tccaacatcaaggaagatg

SEQ ID NO: 9786 - DNA, 18 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
tccaacatcaaggaagat

SEQ ID NO: 9787 - DNA, 17 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
tccaacatcaaggaaga

SEQ ID NO: 9788 - DNA, 16 bp, Artificial Sequence
  Description of Artificial Sequence: Synthetic Antisense oligonucleotide
  misc_feature (1)..(2): bicyclic nucleic acid (BNA)
  misc_feature (2)..(3): 5-methyl
  misc_feature (6)..(6): 5-methyl
  misc_feature (9)..(9): 5-methyl
tccaacatcaaggaag

SEQ ID NO: 9789 - DNA, 28 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(2): bicyclic nucleic acid (BNA)
ccaacatcaaggaagatggcatttctag

SEQ ID NO: 9790 - DNA, 27 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(2): bicyclic nucleic acid (BNA)
ccaacatcaaggaagatggcatttcta

SEQ ID NO: 9791 - DNA, 26 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(2): bicyclic nucleic acid (BNA)
ccaacatcaaggaagatggcatttct

SEQ ID NO: 9792 - DNA, 25 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(2): bicyclic nucleic acid (BNA)
ccaacatcaaggaagatggcatttc

SEQ ID NO: 9793 - DNA, 24 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
ccaacatcaaggaagatggcattt

SEQ ID NO: 9794 - DNA, 23 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
ccaacatcaaggaagatggcatt

SEQ ID NO: 9795 - DNA, 22 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
ccaacatcaaggaagatggcat

SEQ ID NO: 9796 - DNA, 21 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
ccaacatcaaggaagatggca

SEQ ID NO: 9797 - DNA, 20 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
ccaacatcaaggaagatggc

SEQ ID NO: 9798 - DNA, 19 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
ccaacatcaaggaagatgg

SEQ ID NO: 9799 - DNA, 18 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
ccaacatcaaggaagatg

SEQ ID NO: 9800 - DNA, 17 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
ccaacatcaaggaagat

SEQ ID NO: 9801 - DNA, 16 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
ccaacatcaaggaaga

SEQ ID NO: 9802 - DNA, 15 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
ccaacatcaaggaag

SEQ ID NO: 9803 - DNA, 27 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(2): bicyclic nucleic acid (BNA)
caacatcaaggaagatggcatttctag

SEQ ID NO: 9804 - DNA, 26 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(2): bicyclic nucleic acid (BNA)
caacatcaaggaagatggcatttcta

SEQ ID NO: 9805 - DNA, 25 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(2): bicyclic nucleic acid (BNA)
caacatcaaggaagatggcatttct

SEQ ID NO: 9806 - DNA, 24 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(2): bicyclic nucleic acid (BNA)
caacatcaaggaagatggcatttc

SEQ ID NO: 9807 - DNA, 23 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
caacatcaaggaagatggcattt

SEQ ID NO: 9808 - DNA, 22 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
caacatcaaggaagatggcatt

SEQ ID NO: 9809 - DNA, 21 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
caacatcaaggaagatggcat

SEQ ID NO: 9810 - DNA, 20 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
caacatcaaggaagatggca

SEQ ID NO: 9811 - DNA, 19 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
caacatcaaggaagatggc

SEQ ID NO: 9812 - DNA, 18 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
caacatcaaggaagatgg

SEQ ID NO: 9813 - DNA, 17 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
caacatcaaggaagatg

SEQ ID NO: 9814 - DNA, 16 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
caacatcaaggaagat

SEQ ID NO: 9815 - DNA, 15 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
caacatcaaggaaga

SEQ ID NO: 9816 - DNA, 14 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
caacatcaaggaag

SEQ ID NO: 9817 - DNA, 26 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttctag

SEQ ID NO: 9818 - DNA, 25 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttcta

SEQ ID NO: 9819 - DNA, 24 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttct

SEQ ID NO: 9820 - DNA, 23 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttc

SEQ ID NO: 9821 - DNA, 22 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
aacatcaaggaagatggcattt

SEQ ID NO: 9822 - DNA, 21 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
aacatcaaggaagatggcatt

SEQ ID NO: 9823 - DNA, 20 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
aacatcaaggaagatggcat

SEQ ID NO: 9824 - DNA, 19 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
aacatcaaggaagatggca

SEQ ID NO: 9825 - DNA, 18 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
  misc_feature (18)..(18): 5-methyl
aacatcaaggaagatggc

SEQ ID NO: 9826 - DNA, 17 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
aacatcaaggaagatgg

SEQ ID NO: 9827 - DNA, 16 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
aacatcaaggaagatg

SEQ ID NO: 9828 - DNA, 15 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
aacatcaaggaagat

SEQ ID NO: 9829 - DNA, 14 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
aacatcaaggaaga

SEQ ID NO: 9830 - DNA, 13 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (6)..(6): 5-methyl
aacatcaaggaag

SEQ ID NO: 9831 - DNA, 25 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttctag

SEQ ID NO: 9832 - DNA, 24 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttcta

SEQ ID NO: 9833 - DNA, 23 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttct

SEQ ID NO: 9834 - DNA, 22 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttc

SEQ ID NO: 9835 - DNA, 21 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
acatcaaggaagatggcattt

SEQ ID NO: 9836 - DNA, 20 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
acatcaaggaagatggcatt

SEQ ID NO: 9837 - DNA, 19 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
acatcaaggaagatggcat

SEQ ID NO: 9838 - DNA, 18 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
acatcaaggaagatggca

SEQ ID NO: 9839 - DNA, 17 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
  misc_feature (17)..(17): 5-methyl
acatcaaggaagatggc

SEQ ID NO: 9840 - DNA, 16 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
acatcaaggaagatgg

SEQ ID NO: 9841 - DNA, 15 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
acatcaaggaagatg

SEQ ID NO: 9842 - DNA, 14 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
acatcaaggaagat

SEQ ID NO: 9843 - DNA, 13 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
acatcaaggaaga

SEQ ID NO: 9844 - DNA, 12 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (5)..(5): 5-methyl
acatcaaggaag

SEQ ID NO: 9845 - DNA, 24 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(2): bicyclic nucleic acid (BNA)
catcaaggaagatggcatttctag

SEQ ID NO: 9846 - DNA, 23 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(2): bicyclic nucleic acid (BNA)
catcaaggaagatggcatttcta

SEQ ID NO: 9847 - DNA, 22 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(2): bicyclic nucleic acid (BNA)
catcaaggaagatggcatttct

SEQ ID NO: 9848 - DNA, 21 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(2): bicyclic nucleic acid (BNA)
catcaaggaagatggcatttc

SEQ ID NO: 9849 - DNA, 20 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
catcaaggaagatggcattt

SEQ ID NO: 9850 - DNA, 19 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
catcaaggaagatggcatt

SEQ ID NO: 9851 - DNA, 18 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
catcaaggaagatggcat

SEQ ID NO: 9852 - DNA, 17 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
catcaaggaagatggca

SEQ ID NO: 9853 - DNA, 16 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
catcaaggaagatggc

SEQ ID NO: 9854 - DNA, 15 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
catcaaggaagatgg

SEQ ID NO: 9855 - DNA, 14 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
catcaaggaagatg

SEQ ID NO: 9856 - DNA, 13 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
catcaaggaagat

SEQ ID NO: 9857 - DNA, 12 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
catcaaggaaga

SEQ ID NO: 9858 - DNA, 11 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
catcaaggaag

SEQ ID NO: 9859 - DNA, 23 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (15)..(15): 5-methyl
  misc_feature (20)..(20): 5-methyl
atcaaggaagatggcatttctag

SEQ ID NO: 9860 - DNA, 22 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (15)..(15): 5-methyl
  misc_feature (20)..(20): 5-methyl
atcaaggaagatggcatttcta

SEQ ID NO: 9861 - DNA, 21 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (15)..(15): 5-methyl
  misc_feature (20)..(20): 5-methyl
atcaaggaagatggcatttct

SEQ ID NO: 9862 - DNA, 20 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (15)..(15): 5-methyl
  misc_feature (20)..(20): 5-methyl
atcaaggaagatggcatttc

SEQ ID NO: 9863 - DNA, 19 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (15)..(15): 5-methyl
atcaaggaagatggcattt

SEQ ID NO: 9864 - DNA, 18 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (15)..(15): 5-methyl
atcaaggaagatggcatt

SEQ ID NO: 9865 - DNA, 17 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (15)..(15): 5-methyl
atcaaggaagatggcat

SEQ ID NO: 9866 - DNA, 16 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (15)..(15): 5-methyl
atcaaggaagatggca

SEQ ID NO: 9867 - DNA, 15 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
  misc_feature (15)..(15): 5-methyl
atcaaggaagatggc

SEQ ID NO: 9868 - DNA, 14 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
atcaaggaagatgg

SEQ ID NO: 9869 - DNA, 13 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
atcaaggaagatg

SEQ ID NO: 9870 - DNA, 12 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
atcaaggaagat

SEQ ID NO: 9871 - DNA, 11 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
atcaaggaaga

SEQ ID NO: 9872 - DNA, 10 bp, Artificial Sequence
  Description of Artificial Sequence: Synthetic Antisense oligonucleotide
  misc_feature (1)..(2): bicyclic nucleic acid (BNA)
  misc_feature (3)..(3): 5-methyl
atcaaggaag

SEQ ID NO: 9873 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (17)..(18): bicyclic nucleic acid (BNA)
ggtaagttctgtccaagc

SEQ ID NO: 9874 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (17)..(18): bicyclic nucleic acid (BNA)
gtaagttctgtccaagcc

SEQ ID NO: 9875 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (17)..(18): bicyclic nucleic acid (BNA)
agtcggtaagttctgtcc

SEQ ID NO: 9876 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (17)..(18): bicyclic nucleic acid (BNA)
ctgtccaagcccggttga

SEQ ID NO: 9877 - DNA, 15 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (14)..(15): bicyclic nucleic acid (BNA)
taagttctgtccaag

SEQ ID NO: 9878 - DNA, 20 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (19)..(20): bicyclic nucleic acid (BNA)
ttctgtccaagcccggttga

SEQ ID NO: 9879 - DNA, 19 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (18)..(19): bicyclic nucleic acid (BNA)
ttctgtccaagcccggttg

SEQ ID NO: 9880 - DNA, 18 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (17)..(18): bicyclic nucleic acid (BNA)
ttctgtccaagcccggtt

SEQ ID NO: 9881 - DNA, 17 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (16)..(17): bicyclic nucleic acid (BNA)
ttctgtccaagcccggt

SEQ ID NO: 9882 - DNA, 16 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (15)..(16): bicyclic nucleic acid (BNA)
ttctgtccaagcccgg

SEQ ID NO: 9883 - DNA, 15 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (14)..(15): bicyclic nucleic acid (BNA)
ttctgtccaagcccg

SEQ ID NO: 9884 - DNA, 14 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(14): 5-methyl
  misc_feature (13)..(14): bicyclic nucleic acid (BNA)
ttctgtccaagccc

SEQ ID NO: 9885 - DNA, 13 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(13): 5-methyl
  misc_feature (12)..(13): bicyclic nucleic acid (BNA)
ttctgtccaagcc

SEQ ID NO: 9886 - DNA, 12 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (12)..(12): 5-methyl
  misc_feature (11)..(12): bicyclic nucleic acid (BNA)
ttctgtccaagc

SEQ ID NO: 9887 - DNA, 11 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (10)..(11): bicyclic nucleic acid (BNA)
ttctgtccaag

SEQ ID NO: 9888 - DNA, 10 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (9)..(10): bicyclic nucleic acid (BNA)
ttctgtccaa

SEQ ID NO: 9889 - DNA, 9 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (8)..(9): bicyclic nucleic acid (BNA)
ttctgtcca

SEQ ID NO: 9890 - DNA, 8 bp, Artificial Sequence
  Description of Artificial Sequence: Synthetic Antisense oligonucleotide
  misc_feature (3)..(3): 5-methyl
  misc_feature (7)..(8): 5-methyl
  misc_feature (7)..(8): bicyclic nucleic acid (BNA)
ttctgtcc

SEQ ID NO: 9891 - DNA, 19 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (18)..(19): bicyclic nucleic acid (BNA)
tctgtccaagcccggttga

SEQ ID NO: 9892 - DNA, 18 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (17)..(18): bicyclic nucleic acid (BNA)
tctgtccaagcccggttg

SEQ ID NO: 9893 - DNA, 17 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (16)..(17): bicyclic nucleic acid (BNA)
tctgtccaagcccggtt

SEQ ID NO: 9894 - DNA, 16 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (15)..(16): bicyclic nucleic acid (BNA)
tctgtccaagcccggt

SEQ ID NO: 9895 - DNA, 15 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (14)..(15): bicyclic nucleic acid (BNA)
tctgtccaagcccgg

SEQ ID NO: 9896 - DNA, 14 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (13)..(14): bicyclic nucleic acid (BNA)
tctgtccaagcccg

SEQ ID NO: 9897 - DNA, 13 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(13): 5-methyl
  misc_feature (12)..(13): bicyclic nucleic acid (BNA)
tctgtccaagccc

SEQ ID NO: 9898 - DNA, 12 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(12): 5-methyl
  misc_feature (11)..(12): bicyclic nucleic acid (BNA)
tctgtccaagcc

SEQ ID NO: 9899 - DNA, 11 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (11)..(11): 5-methyl
  misc_feature (10)..(11): bicyclic nucleic acid (BNA)
tctgtccaagc

SEQ ID NO: 9900 - DNA, 10 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (9)..(10): bicyclic nucleic acid (BNA)
tctgtccaag

SEQ ID NO: 9901 - DNA, 9 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (8)..(9): bicyclic nucleic acid (BNA)
tctgtccaa

SEQ ID NO: 9902 - DNA, 8 bp, Artificial Sequence
  Description of Artificial Sequence: Synthetic Antisense oligonucleotide
  misc_feature (2)..(2): 5-methyl
  misc_feature (6)..(7): 5-methyl
  misc_feature (7)..(8): bicyclic nucleic acid (BNA)
tctgtcca

SEQ ID NO: 9903 - DNA, 17 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (16)..(17): bicyclic nucleic acid (BNA)
ctgtccaagcccggttg

SEQ ID NO: 9904 - DNA, 16 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (15)..(16): bicyclic nucleic acid (BNA)
ctgtccaagcccggtt

SEQ ID NO: 9905 - DNA, 15 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (14)..(15): bicyclic nucleic acid (BNA)
ctgtccaagcccggt

SEQ ID NO: 9906 - DNA, 14 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(14): bicyclic nucleic acid (BNA)
ctgtccaagcccgg

SEQ ID NO: 9907 - DNA, 13 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(13): bicyclic nucleic acid (BNA)
ctgtccaagcccg

SEQ ID NO: 9908 - DNA, 12 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(12): bicyclic nucleic acid (BNA)
ctgtccaagccc

SEQ ID NO: 9909 - DNA, 11 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(11): 5-methyl
  misc_feature (10)..(11): bicyclic nucleic acid (BNA)
ctgtccaagcc

SEQ ID NO: 9910 - DNA, 10 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(10): 5-methyl
  misc_feature (9)..(10): bicyclic nucleic acid (BNA)
ctgtccaagc

SEQ ID NO: 9911 - DNA, 9 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (8)..(9): bicyclic nucleic acid (BNA)
ctgtccaag

SEQ ID NO: 9912 - DNA, 8 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (7)..(8): bicyclic nucleic acid (BNA)
ctgtccaa

SEQ ID NO: 9913 - DNA, 20 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (19)..(20): bicyclic nucleic acid (BNA)
gttctgtccaagcccggttg

SEQ ID NO: 9914 - DNA, 19 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (18)..(19): bicyclic nucleic acid (BNA)
gttctgtccaagcccggtt

SEQ ID NO: 9915 - DNA, 18 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (17)..(18): bicyclic nucleic acid (BNA)
gttctgtccaagcccggt

SEQ ID NO: 9916 - DNA, 17 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (16)..(17): bicyclic nucleic acid (BNA)
gttctgtccaagcccgg

SEQ ID NO: 9917 - DNA, 16 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (15)..(16): bicyclic nucleic acid (BNA)
gttctgtccaagcccg

SEQ ID NO: 9918 - DNA, 15 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(15): 5-methyl
  misc_feature (14)..(15): bicyclic nucleic acid (BNA)
gttctgtccaagccc

SEQ ID NO: 9919 - DNA, 14 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(14): 5-methyl
  misc_feature (13)..(14): bicyclic nucleic acid (BNA)
gttctgtccaagcc

SEQ ID NO: 9920 - DNA, 13 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (13)..(13): 5-methyl
  misc_feature (12)..(13): bicyclic nucleic acid (BNA)
gttctgtccaagc

SEQ ID NO: 9921 - DNA, 12 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (11)..(12): bicyclic nucleic acid (BNA)
gttctgtccaag

SEQ ID NO: 9922 - DNA, 11 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (10)..(11): bicyclic nucleic acid (BNA)
gttctgtccaa

SEQ ID NO: 9923 - DNA, 10 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (9)..(10): bicyclic nucleic acid (BNA)
gttctgtcca

SEQ ID NO: 9924 - DNA, 9 bp, Artificial Sequence
  Description of Artificial Sequence: Synthetic Antisense oligonucleotide
  misc_feature (4)..(4): 5-methyl
  misc_feature (8)..(9): 5-methyl
  misc_feature (8)..(9): bicyclic nucleic acid (BNA)
gttctgtcc

SEQ ID NO: 9925 - DNA, 8 bp, Artificial Sequence
  Description of Artificial Sequence: Synthetic Antisense oligonucleotide
  misc_feature (4)..(4): 5-methyl
  misc_feature (8)..(8): 5-methyl
  misc_feature (7)..(8): bicyclic nucleic acid (BNA)
gttctgtc

SEQ ID NO: 9926 - DNA, 20 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
  misc_feature (19)..(20): bicyclic nucleic acid (BNA)
agttctgtccaagcccggtt

SEQ ID NO: 9927 - DNA, 19 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
  misc_feature (18)..(19): bicyclic nucleic acid (BNA)
agttctgtccaagcccggt

SEQ ID NO: 9928 - DNA, 18 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
  misc_feature (17)..(18): bicyclic nucleic acid (BNA)
agttctgtccaagcccgg

SEQ ID NO: 9929 - DNA, 17 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
  misc_feature (16)..(17): bicyclic nucleic acid (BNA)
agttctgtccaagcccg

SEQ ID NO: 9930 - DNA, 16 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(16): 5-methyl
  misc_feature (15)..(16): bicyclic nucleic acid (BNA)
agttctgtccaagccc

SEQ ID NO: 9931 - DNA, 15 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(15): 5-methyl
  misc_feature (14)..(15): bicyclic nucleic acid (BNA)
agttctgtccaagcc

SEQ ID NO: 9932 - DNA, 14 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (14)..(14): 5-methyl
  misc_feature (13)..(14): bicyclic nucleic acid (BNA)
agttctgtccaagc

SEQ ID NO: 9933 - DNA, 13 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (12)..(13): bicyclic nucleic acid (BNA)
agttctgtccaag

SEQ ID NO: 9934 - DNA, 12 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (11)..(12): bicyclic nucleic acid (BNA)
agttctgtccaa

SEQ ID NO: 9935 - DNA, 11 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (10)..(11): bicyclic nucleic acid (BNA)
agttctgtcca

SEQ ID NO: 9936 - DNA, 10 bp, Artificial Sequence
  Description of Artificial Sequence: Synthetic Antisense oligonucleotide
  misc_feature (5)..(5): 5-methyl
  misc_feature (9)..(10): 5-methyl
  misc_feature (9)..(10): bicyclic nucleic acid (BNA)
agttctgtcc

SEQ ID NO: 9937 - DNA, 9 bp, Artificial Sequence
  Description of Artificial Sequence: Synthetic Antisense oligonucleotide
  misc_feature (5)..(5): 5-methyl
  misc_feature (9)..(9): 5-methyl
  misc_feature (8)..(9): bicyclic nucleic acid (BNA)
agttctgtc

SEQ ID NO: 9938 - DNA, 8 bp, Artificial Sequence
  Description of Artificial Sequence: Synthetic Antisense oligonucleotide
  misc_feature (5)..(5): 5-methyl
  misc_feature (7)..(8): bicyclic nucleic acid (BNA)
agttctgt

SEQ ID NO: 9939 - DNA, 20 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
  misc_feature (19)..(20): bicyclic nucleic acid (BNA)
aagttctgtccaagcccggt

SEQ ID NO: 9940 - DNA, 19 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
  misc_feature (18)..(19): bicyclic nucleic acid (BNA)
aagttctgtccaagcccgg

SEQ ID NO: 9941 - DNA, 18 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
  misc_feature (17)..(18): bicyclic nucleic acid (BNA)
aagttctgtccaagcccg

SEQ ID NO: 9942 - DNA, 17 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(17): 5-methyl
  misc_feature (16)..(17): bicyclic nucleic acid (BNA)
aagttctgtccaagccc

SEQ ID NO: 9943 - DNA, 16 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(16): 5-methyl
  misc_feature (15)..(16): bicyclic nucleic acid (BNA)
aagttctgtccaagcc

SEQ ID NO: 9944 - DNA, 15 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (15)..(15): 5-methyl
  misc_feature (14)..(15): bicyclic nucleic acid (BNA)
aagttctgtccaagc

SEQ ID NO: 9945 - DNA, 14 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (13)..(14): bicyclic nucleic acid (BNA)
aagttctgtccaag

SEQ ID NO: 9946 - DNA, 13 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (12)..(13): bicyclic nucleic acid (BNA)
aagttctgtccaa

SEQ ID NO: 9947 - DNA, 12 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (11)..(12): bicyclic nucleic acid (BNA)
aagttctgtcca

SEQ ID NO: 9948 - DNA, 11 bp, Artificial Sequence
  Description of Artificial Sequence: Synthetic Antisense oligonucleotide
  misc_feature (6)..(6): 5-methyl
  misc_feature (10)..(11): 5-methyl
  misc_feature (10)..(11): bicyclic nucleic acid (BNA)
aagttctgtcc

SEQ ID NO: 9949 - DNA, 10 bp, Artificial Sequence
  Description of Artificial Sequence: Synthetic Antisense oligonucleotide
  misc_feature (6)..(6): 5-methyl
  misc_feature (10)..(10): 5-methyl
  misc_feature (9)..(10): bicyclic nucleic acid (BNA)
aagttctgtc

SEQ ID NO: 9950 - DNA, 9 bp, Artificial Sequence
  Description of Artificial Sequence: Synthetic Antisense oligonucleotide
  misc_feature (6)..(6): 5-methyl
  misc_feature (8)..(9): bicyclic nucleic acid (BNA)
aagttctgt

SEQ ID NO: 9951 - DNA, 8 bp, Artificial Sequence
  Description of Artificial Sequence: Synthetic Antisense oligonucleotide
  misc_feature (6)..(6): 5-methyl
  misc_feature (7)..(8): bicyclic nucleic acid (BNA)
aagttctg

SEQ ID NO: 9952 - DNA, 20 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
  misc_feature (19)..(20): bicyclic nucleic acid (BNA)
taagttctgtccaagcccgg

SEQ ID NO: 9953 - DNA, 19 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
  misc_feature (18)..(19): bicyclic nucleic acid (BNA)
taagttctgtccaagcccg

SEQ ID NO: 9954 - DNA, 18 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(18): 5-methyl
  misc_feature (17)..(18): bicyclic nucleic acid (BNA)
taagttctgtccaagccc

SEQ ID NO: 9955 - DNA, 17 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(17): 5-methyl
  misc_feature (16)..(17): bicyclic nucleic acid (BNA)
taagttctgtccaagcc

SEQ ID NO: 9956 - DNA, 16 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (16)..(16): 5-methyl
  misc_feature (15)..(16): bicyclic nucleic acid (BNA)
taagttctgtccaagc

SEQ ID NO: 9957 - DNA, 14 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (13)..(14): bicyclic nucleic acid (BNA)
taagttctgtccaa

SEQ ID NO: 9958 - DNA, 13 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (12)..(13): bicyclic nucleic acid (BNA)
taagttctgtcca

SEQ ID NO: 9959 - DNA, 12 bp, Artificial Sequence
  Description of Artificial Sequence: Synthetic Antisense oligonucleotide
  misc_feature (7)..(7): 5-methyl
  misc_feature (11)..(12): 5-methyl
  misc_feature (11)..(12): bicyclic nucleic acid (BNA)
taagttctgtcc

SEQ ID NO: 9960 - DNA, 11 bp, Artificial Sequence
  Description of Artificial Sequence: Synthetic Antisense oligonucleotide
  misc_feature (7)..(7): 5-methyl
  misc_feature (11)..(11): 5-methyl
  misc_feature (10)..(11): bicyclic nucleic acid (BNA)
taagttctgtc

SEQ ID NO: 9961 - DNA, 10 bp, Artificial Sequence
  Description of Artificial Sequence: Synthetic Antisense oligonucleotide
  misc_feature (7)..(7): 5-methyl
  misc_feature (9)..(10): bicyclic nucleic acid (BNA)
taagttctgt

SEQ ID NO: 9962 - DNA, 9 bp, Artificial Sequence
  Description of Artificial Sequence: Synthetic Antisense oligonucleotide
  misc_feature (7)..(7): 5-methyl
  misc_feature (8)..(9): bicyclic nucleic acid (BNA)
taagttctg

SEQ ID NO: 9963 - DNA, 8 bp, Artificial Sequence
  Description of Artificial Sequence: Synthetic Antisense oligonucleotide
  misc_feature (7)..(7): 5-methyl
  misc_feature (7)..(8): bicyclic nucleic acid (BNA)
taagttct

SEQ ID NO: 9964 - DNA, 20 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(19): 5-methyl
  misc_feature (19)..(20): bicyclic nucleic acid (BNA)
gtaagttctgtccaagcccg

SEQ ID NO: 9965 - DNA, 19 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(19): 5-methyl
  misc_feature (18)..(19): bicyclic nucleic acid (BNA)
gtaagttctgtccaagccc

SEQ ID NO: 9966 - DNA, 17 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(17): 5-methyl
  misc_feature (16)..(17): bicyclic nucleic acid (BNA)
gtaagttctgtccaagc

SEQ ID NO: 9967 - DNA, 16 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (15)..(16): bicyclic nucleic acid (BNA)
gtaagttctgtccaag

SEQ ID NO: 9968 - DNA, 15 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (14)..(15): bicyclic nucleic acid (BNA)
gtaagttctgtccaa

SEQ ID NO: 9969 - DNA, 14 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (13)..(14): bicyclic nucleic acid (BNA)
gtaagttctgtcca

SEQ ID NO: 9970 - DNA, 13 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (12)..(13): bicyclic nucleic acid (BNA)
gtaagttctgtcc

SEQ ID NO: 9971 - DNA, 12 bp, Artificial Sequence
  Description of Artificial Sequence: Synthetic Antisense oligonucleotide
  misc_feature (8)..(8): 5-methyl
  misc_feature (12)..(12): 5-methyl
  misc_feature (11)..(12): bicyclic nucleic acid (BNA)
gtaagttctgtc

SEQ ID NO: 9972 - DNA, 11 bp, Artificial Sequence
  Description of Artificial Sequence: Synthetic Antisense oligonucleotide
  misc_feature (8)..(8): 5-methyl
  misc_feature (10)..(11): bicyclic nucleic acid (BNA)
gtaagttctgt

SEQ ID NO: 9973 - DNA, 10 bp, Artificial Sequence
  Description of Artificial Sequence: Synthetic Antisense oligonucleotide
  misc_feature (8)..(8): 5-methyl
  misc_feature (9)..(10): bicyclic nucleic acid (BNA)
gtaagttctg

SEQ ID NO: 9974 - DNA, 9 bp, Artificial Sequence
  Description of Artificial Sequence: Synthetic Antisense oligonucleotide
  misc_feature (8)..(8): 5-methyl
  misc_feature (8)..(9): bicyclic nucleic acid (BNA)
gtaagttct

SEQ ID NO: 9975 - DNA, 8 bp, Artificial Sequence
  Description of Artificial Sequence: Synthetic Antisense oligonucleotide
  misc_feature (7)..(8): bicyclic nucleic acid (BNA)
  misc_feature (8)..(8): 5-methyl
gtaagttc

SEQ ID NO: 9976 - DNA, 20 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(20): 5-methyl
  misc_feature (19)..(20): bicyclic nucleic acid (BNA)
ggtaagttctgtccaagccc

SEQ ID NO: 9977 - DNA, 19 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(19): 5-methyl
  misc_feature (18)..(19): bicyclic nucleic acid (BNA)
ggtaagttctgtccaagcc

SEQ ID NO: 9978 - DNA, 17 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (16)..(17): bicyclic nucleic acid (BNA)
ggtaagttctgtccaag

SEQ ID NO: 9979 - DNA, 16 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (15)..(16): bicyclic nucleic acid (BNA)
ggtaagttctgtccaa

SEQ ID NO: 9980 - DNA, 15 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (14)..(15): bicyclic nucleic acid (BNA)
ggtaagttctgtcca

SEQ ID NO: 9981 - DNA, 14 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (13)..(14): bicyclic nucleic acid (BNA)
ggtaagttctgtcc

SEQ ID NO: 9982 - DNA, 13 bp, Artificial Sequence
  Description of Artificial Sequence: Synthetic Antisense oligonucleotide
  misc_feature (9)..(9): 5-methyl
  misc_feature (13)..(13): 5-methyl
  misc_feature (12)..(13): bicyclic nucleic acid (BNA)
ggtaagttctgtc

SEQ ID NO: 9983 - DNA, 12 bp, Artificial Sequence
  Description of Artificial Sequence: Synthetic Antisense oligonucleotide
  misc_feature (9)..(9): 5-methyl
  misc_feature (11)..(12): bicyclic nucleic acid (BNA)
ggtaagttctgt

SEQ ID NO: 9984 - DNA, 11 bp, Artificial Sequence
  Description of Artificial Sequence: Synthetic Antisense oligonucleotide
  misc_feature (9)..(9): 5-methyl
  misc_feature (10)..(11): bicyclic nucleic acid (BNA)
ggtaagttctg

SEQ ID NO: 9985 - DNA, 10 bp, Artificial Sequence
  Description of Artificial Sequence: Synthetic Antisense oligonucleotide
  misc_feature (9)..(9): 5-methyl
  misc_feature (9)..(10): bicyclic nucleic acid (BNA)
ggtaagttct

SEQ ID NO: 9986 - DNA, 9 bp, Artificial Sequence
  Description of Artificial Sequence: Synthetic Antisense oligonucleotide
  misc_feature (8)..(9): bicyclic nucleic acid (BNA)
  misc_feature (9)..(9): 5-methyl
ggtaagttc

SEQ ID NO: 9987 - DNA, 20 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(20): 5-methyl
  misc_feature (19)..(20): bicyclic nucleic acid (BNA)
cggtaagttctgtccaagcc

SEQ ID NO: 9988 - DNA, 19 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(19): 5-methyl
  misc_feature (18)..(19): bicyclic nucleic acid (BNA)
cggtaagttctgtccaagc

SEQ ID NO: 9989 - DNA, 18 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (17)..(18): bicyclic nucleic acid (BNA)
cggtaagttctgtccaag

SEQ ID NO: 9990 - DNA, 17 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (16)..(17): bicyclic nucleic acid (BNA)
cggtaagttctgtccaa

SEQ ID NO: 9991 - DNA, 16 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (15)..(16): bicyclic nucleic acid (BNA)
cggtaagttctgtcca

SEQ ID NO: 9992 - DNA, 15 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (14)..(15): bicyclic nucleic acid (BNA)
cggtaagttctgtcc

SEQ ID NO: 9993 - DNA, 14 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(14): 5-methyl
  misc_feature (13)..(14): bicyclic nucleic acid (BNA)
cggtaagttctgtc

SEQ ID NO: 9994 - DNA, 13 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (12)..(13): bicyclic nucleic acid (BNA)
cggtaagttctgt

SEQ ID NO: 9995 - DNA, 12 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (11)..(12): bicyclic nucleic acid (BNA)
cggtaagttctg

SEQ ID NO: 9996 - DNA, 11 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (10)..(11): bicyclic nucleic acid (BNA)
cggtaagttct

SEQ ID NO: 9997 - DNA, 10 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (9)..(10): bicyclic nucleic acid (BNA)
cggtaagttc

SEQ ID NO: 9998 - DNA, 9 bp, Artificial Sequence
  Description of Artificial Sequence: Synthetic Antisense oligonucleotide
  misc_feature (1)..(1): 5-methyl
  misc_feature (8)..(9): bicyclic nucleic acid (BNA)
cggtaagtt

SEQ ID NO: 9999 - DNA, 8 bp, Artificial Sequence
  Description of Artificial Sequence: Synthetic Antisense oligonucleotide
  misc_feature (1)..(1): 5-methyl
  misc_feature (7)..(8): bicyclic nucleic acid (BNA)
cggtaagt

SEQ ID NO: 10000 - DNA, 20 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (20)..(20): 5-methyl
  misc_feature (19)..(20): bicyclic nucleic acid (BNA)
tcggtaagttctgtccaagc

SEQ ID NO: 10001 - DNA, 19 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (18)..(19): bicyclic nucleic acid (BNA)
tcggtaagttctgtccaag

SEQ ID NO: 10002 - DNA, 18 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (17)..(18): bicyclic nucleic acid (BNA)
tcggtaagttctgtccaa

SEQ ID NO: 10003 - DNA, 17 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (16)..(17): bicyclic nucleic acid (BNA)
tcggtaagttctgtcca

SEQ ID NO: 10004 - DNA, 16 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(16): 5-methyl
  misc_feature (15)..(16): bicyclic nucleic acid (BNA)
tcggtaagttctgtcc

SEQ ID NO: 10005 - DNA, 15 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (15)..(15): 5-methyl
  misc_feature (14)..(15): bicyclic nucleic acid (BNA)
tcggtaagttctgtc

SEQ ID NO: 10006 - DNA, 14 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (13)..(14): bicyclic nucleic acid (BNA)
tcggtaagttctgt

SEQ ID NO: 10007 - DNA, 13 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (12)..(13): bicyclic nucleic acid (BNA)
tcggtaagttctg

SEQ ID NO: 10008 - DNA, 12 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (11)..(12): bicyclic nucleic acid (BNA)
tcggtaagttct

SEQ ID NO: 10009 - DNA, 11 bp, Artificial Sequence
  Description of Artificial Sequence: Synthetic Antisense oligonucleotide
  misc_feature (2)..(2): 5-methyl
  misc_feature (11)..(11): 5-methyl
  misc_feature (10)..(11): bicyclic nucleic acid (BNA)
tcggtaagttc

SEQ ID NO: 10010 - DNA, 10 bp, Artificial Sequence
  Description of Artificial Sequence: Synthetic Antisense oligonucleotide
  misc_feature (2)..(2): 5-methyl
  misc_feature (9)..(10): bicyclic nucleic acid (BNA)
tcggtaagtt

SEQ ID NO: 10011 - DNA, 9 bp, Artificial Sequence
  Description of Artificial Sequence: Synthetic Antisense oligonucleotide
  misc_feature (2)..(2): 5-methyl
  misc_feature (8)..(9): bicyclic nucleic acid (BNA)
tcggtaagt

SEQ ID NO: 10012 - DNA, 20 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
  misc_feature (19)..(20): bicyclic nucleic acid (BNA)
gtcggtaagttctgtccaag

SEQ ID NO: 10013 - DNA, 19 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
  misc_feature (18)..(19): bicyclic nucleic acid (BNA)
gtcggtaagttctgtccaa

SEQ ID NO: 10014 - DNA, 18 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
  misc_feature (17)..(18): bicyclic nucleic acid (BNA)
gtcggtaagttctgtcca

SEQ ID NO: 10015 - DNA, 17 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(17): 5-methyl
  misc_feature (16)..(17): bicyclic nucleic acid (BNA)
gtcggtaagttctgtcc

SEQ ID NO: 10016 - DNA, 16 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (16)..(16): 5-methyl
  misc_feature (15)..(16): bicyclic nucleic acid (BNA)
gtcggtaagttctgtc

SEQ ID NO: 10017 - DNA, 15 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (14)..(15): bicyclic nucleic acid (BNA)
gtcggtaagttctgt

SEQ ID NO: 10018 - DNA, 14 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (13)..(14): bicyclic nucleic acid (BNA)
gtcggtaagttctg

SEQ ID NO: 10019 - DNA, 13 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (12)..(13): bicyclic nucleic acid (BNA)
gtcggtaagttct

SEQ ID NO: 10020 - DNA, 12 bp, Artificial Sequence
  Description of Artificial Sequence: Synthetic Antisense oligonucleotide
  misc_feature (3)..(3): 5-methyl
  misc_feature (12)..(12): 5-methyl
  misc_feature (11)..(12): bicyclic nucleic acid (BNA)
gtcggtaagttc

SEQ ID NO: 10021 - DNA, 11 bp, Artificial Sequence
  Description of Artificial Sequence: Synthetic Antisense oligonucleotide
  misc_feature (3)..(3): 5-methyl
  misc_feature (10)..(11): bicyclic nucleic acid (BNA)
gtcggtaagtt

SEQ ID NO: 10022 - DNA, 10 bp, Artificial Sequence
  Description of Artificial Sequence: Synthetic Antisense oligonucleotide
  misc_feature (3)..(3): 5-methyl
  misc_feature (9)..(10): bicyclic nucleic acid (BNA)
gtcggtaagt

SEQ ID NO: 10023 - DNA, 20 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (19)..(20): bicyclic nucleic acid (BNA)
agtcggtaagttctgtccaa

SEQ ID NO: 10024 - DNA, 19 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (18)..(19): bicyclic nucleic acid (BNA)
agtcggtaagttctgtcca

SEQ ID NO: 10025 - DNA, 17 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(17): 5-methyl
  misc_feature (16)..(17): bicyclic nucleic acid (BNA)
agtcggtaagttctgtc

SEQ ID NO: 10026 - DNA, 16 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (15)..(16): bicyclic nucleic acid (BNA)
agtcggtaagttctgt

SEQ ID NO: 10027 - DNA, 15 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (14)..(15): bicyclic nucleic acid (BNA)
agtcggtaagttctg

SEQ ID NO: 10028 - DNA, 14 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (13)..(14): bicyclic nucleic acid (BNA)
agtcggtaagttct

SEQ ID NO: 10029 - DNA, 13 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (12)..(13): bicyclic nucleic acid (BNA)
agtcggtaagttc

SEQ ID NO: 10030 - DNA, 12 bp, Artificial Sequence
  Description of Artificial Sequence: Synthetic Antisense oligonucleotide
  misc_feature (4)..(4): 5-methyl
  misc_feature (11)..(12): bicyclic nucleic acid (BNA)
agtcggtaagtt

SEQ ID NO: 10031 - DNA, 11 bp, Artificial Sequence
  Description of Artificial Sequence: Synthetic Antisense oligonucleotide
  misc_feature (4)..(4): 5-methyl
  misc_feature (10)..(11): bicyclic nucleic acid (BNA)
agtcggtaagt

SEQ ID NO: 10032 - DNA, 20 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (19)..(20): bicyclic nucleic acid (BNA)
cagtcggtaagttctgtcca

SEQ ID NO: 10033 - DNA, 19 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (18)..(19): bicyclic nucleic acid (BNA)
cagtcggtaagttctgtcc

SEQ ID NO: 10034 - DNA, 18 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(18): 5-methyl
  misc_feature (17)..(18): bicyclic nucleic acid (BNA)
cagtcggtaagttctgtc

SEQ ID NO: 10035 - DNA, 17 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (16)..(17): bicyclic nucleic acid (BNA)
cagtcggtaagttctgt

SEQ ID NO: 10036 - DNA, 16 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (15)..(16): bicyclic nucleic acid (BNA)
cagtcggtaagttctg

SEQ ID NO: 10037 - DNA, 15 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (14)..(15): bicyclic nucleic acid (BNA)
cagtcggtaagttct

SEQ ID NO: 10038 - DNA, 14 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (13)..(14): bicyclic nucleic acid (BNA)
cagtcggtaagttc

SEQ ID NO: 10039 - DNA, 13 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (12)..(13): bicyclic nucleic acid (BNA)
cagtcggtaagtt

SEQ ID NO: 10040 - DNA, 12 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (11)..(12): bicyclic nucleic acid (BNA)
cagtcggtaagt

SEQ ID NO: 10041 - DNA, 20 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(20): 5-methyl
  misc_feature (19)..(20): bicyclic nucleic acid (BNA)
ccagtcggtaagttctgtcc

SEQ ID NO: 10042 - DNA, 19 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(19): 5-methyl
  misc_feature (18)..(19): bicyclic nucleic acid (BNA)
ccagtcggtaagttctgtc

SEQ ID NO: 10043 - DNA, 18 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (17)..(18): bicyclic nucleic acid (BNA)
ccagtcggtaagttctgt

SEQ ID NO: 10044 - DNA, 17 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (16)..(17): bicyclic nucleic acid (BNA)
ccagtcggtaagttctg

SEQ ID NO: 10045 - DNA, 16 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (15)..(16): bicyclic nucleic acid (BNA)
ccagtcggtaagttct

SEQ ID NO: 10046 - DNA, 15 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (14)..(15): bicyclic nucleic acid (BNA)
ccagtcggtaagttc

SEQ ID NO: 10047 - DNA, 14 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (13)..(14): bicyclic nucleic acid (BNA)
ccagtcggtaagtt

SEQ ID NO: 10048 - DNA, 13 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (12)..(13): bicyclic nucleic acid (BNA)
ccagtcggtaagt

SEQ ID NO: 10049 - DNA, 20 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
  misc_feature (20)..(20): 5-methyl
  misc_feature (19)..(20): bicyclic nucleic acid (BNA)
gccagtcggtaagttctgtc

SEQ ID NO: 10050 - DNA, 19 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
  misc_feature (18)..(19): bicyclic nucleic acid (BNA)
gccagtcggtaagttctgt

SEQ ID NO: 10051 - DNA, 18 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
  misc_feature (17)..(18): bicyclic nucleic acid (BNA)
gccagtcggtaagttctg

SEQ ID NO: 10052 - DNA, 17 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
  misc_feature (16)..(17): bicyclic nucleic acid (BNA)
gccagtcggtaagttct

SEQ ID NO: 10053 - DNA, 16 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (16)..(16): 5-methyl
  misc_feature (15)..(16): bicyclic nucleic acid (BNA)
gccagtcggtaagttc

SEQ ID NO: 10054 - DNA, 15 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (14)..(15): bicyclic nucleic acid (BNA)
gccagtcggtaagtt

SEQ ID NO: 10055 - DNA, 14 bp, Artificial Sequence
  Description of Artificial Sequence: Synthetic Antisense oligonucleotide
  misc_feature (2)..(3): 5-methyl
  misc_feature (7)..(7): 5-methyl
  misc_feature (13)..(14): bicyclic nucleic acid (BNA)
gccagtcggtaagt

SEQ ID NO: 10056 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (19)..(20): bicyclic nucleic acid (BNA)
tcaaggaagatggcatttct

SEQ ID NO: 10057 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (21)..(22): bicyclic nucleic acid (BNA)
tcaaggaagatggcatttctag

SEQ ID NO: 10058 - DNA, 16 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (15)..(16): bicyclic nucleic acid (BNA)
tcaaggaagatggcat

SEQ ID NO: 10059 - DNA, 15 bp, Artificial Sequence
  Description of Artificial Sequence: Synthetic Antisense oligonucleotide
  misc_feature (9)..(9): 5-methyl
  misc_feature (14)..(14): 5-methyl
  misc_feature (14)..(15): bicyclic nucleic acid (BNA)
gaagatggcatttct

SEQ ID NO: 10060 - DNA, 21 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (20)..(21): bicyclic nucleic acid (BNA)
tcaaggaagatggcatttcta

SEQ ID NO: 10061 - DNA, 19 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (18)..(19): bicyclic nucleic acid (BNA)
tcaaggaagatggcatttc

SEQ ID NO: 10062 - DNA, 18 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (17)..(18): bicyclic nucleic acid (BNA)
tcaaggaagatggcattt

SEQ ID NO: 10063 - DNA, 17 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (16)..(17): bicyclic nucleic acid (BNA)
tcaaggaagatggcatt

SEQ ID NO: 10064 - DNA, 15 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (14)..(15): bicyclic nucleic acid (BNA)
tcaaggaagatggca

SEQ ID NO: 10065 - DNA, 14 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (13)..(14): bicyclic nucleic acid (BNA)
tcaaggaagatggc

SEQ ID NO: 10066 - DNA, 13 bp, Artificial Sequence
  Description of Artificial Sequence: Synthetic Antisense oligonucleotide
  misc_feature (2)..(2): 5-methyl
  misc_feature (12)..(13): bicyclic nucleic acid (BNA)
tcaaggaagatgg

SEQ ID NO: 10067 - DNA, 12 bp, Artificial Sequence
  Description of Artificial Sequence: Synthetic Antisense oligonucleotide
  misc_feature (2)..(2): 5-methyl
  misc_feature (11)..(12): bicyclic nucleic acid (BNA)
tcaaggaagatg

SEQ ID NO: 10068 - DNA, 11 bp, Artificial Sequence
  Description of Artificial Sequence: Synthetic Antisense oligonucleotide
  misc_feature (2)..(2): 5-methyl
  misc_feature (10)..(11): bicyclic nucleic acid (BNA)
tcaaggaagat

SEQ ID NO: 10069 - DNA, 10 bp, Artificial Sequence
  Description of Artificial Sequence: Synthetic Antisense oligonucleotide
  misc_feature (2)..(2): 5-methyl
  misc_feature (9)..(10): bicyclic nucleic acid (BNA)
tcaaggaaga

SEQ ID NO: 10070 - DNA, 9 bp, Artificial Sequence
  Description of Artificial Sequence: Synthetic Antisense oligonucleotide
  misc_feature (2)..(2): 5-methyl
  misc_feature (8)..(9): bicyclic nucleic acid (BNA)
tcaaggaag

SEQ ID NO: 10071 - DNA, 21 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (20)..(21): bicyclic nucleic acid (BNA)
caaggaagatggcatttctag

SEQ ID NO: 10072 - DNA, 20 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (19)..(20): bicyclic nucleic acid (BNA)
caaggaagatggcatttcta

SEQ ID NO: 10073 - DNA, 19 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (18)..(19): bicyclic nucleic acid (BNA)
caaggaagatggcatttct

SEQ ID NO: 10074 - DNA, 18 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (17)..(18): bicyclic nucleic acid (BNA)
caaggaagatggcatttc

SEQ ID NO: 10075 - DNA, 17 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (16)..(17): bicyclic nucleic acid (BNA)
caaggaagatggcattt

SEQ ID NO: 10076 - DNA, 16 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (15)..(16): bicyclic nucleic acid (BNA)
caaggaagatggcatt

SEQ ID NO: 10077 - DNA, 15 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (14)..(15): bicyclic nucleic acid (BNA)
caaggaagatggcat

SEQ ID NO: 10078 - DNA, 14 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (13)..(14): bicyclic nucleic acid (BNA)
caaggaagatggca

SEQ ID NO: 10079 - DNA, 13 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (12)..(13): bicyclic nucleic acid (BNA)
caaggaagatggc

SEQ ID NO: 10080 - DNA, 12 bp, Artificial Sequence
  Description of Artificial Sequence: Synthetic Antisense oligonucleotide
  misc_feature (1)..(1): 5-methyl
  misc_feature (11)..(12): bicyclic nucleic acid (BNA)
caaggaagatgg

SEQ ID NO: 10081 - DNA, 11 bp, Artificial Sequence
  Description of Artificial Sequence: Synthetic Antisense oligonucleotide
  misc_feature (1)..(1): 5-methyl
  misc_feature (10)..(11): bicyclic nucleic acid (BNA)
caaggaagatg

SEQ ID NO: 10082 - DNA, 10 bp, Artificial Sequence
  Description of Artificial Sequence: Synthetic Antisense oligonucleotide
  misc_feature (1)..(1): 5-methyl
  misc_feature (9)..(10): bicyclic nucleic acid (BNA)
caaggaagat

SEQ ID NO: 10083 - DNA, 20 bp, Artificial Sequence
  Description of Artificial Sequence: Synthetic Antisense oligonucleotide
  misc_feature (12)..(12): 5-methyl
  misc_feature (17)..(17): 5-methyl
  misc_feature (19)..(20): bicyclic nucleic acid (BNA)
aaggaagatggcatttctag

SEQ ID NO: 10084 - DNA, 19 bp, Artificial Sequence
  Description of Artificial Sequence: Synthetic Antisense oligonucleotide
  misc_feature (12)..(12): 5-methyl
  misc_feature (17)..(17): 5-methyl
  misc_feature (18)..(19): bicyclic nucleic acid (BNA)
aaggaagatggcatttcta

SEQ ID NO: 10085 - DNA, 18 bp, Artificial Sequence
  Description of Artificial Sequence: Synthetic Antisense oligonucleotide
  misc_feature (12)..(12): 5-methyl
  misc_feature (17)..(17): 5-methyl
  misc_feature (17)..(18): bicyclic nucleic acid (BNA)
aaggaagatggcatttct

SEQ ID NO: 10086 - DNA, 17 bp, Artificial Sequence
  Description of Artificial Sequence: Synthetic Antisense oligonucleotide
  misc_feature (12)..(12): 5-methyl
  misc_feature (17)..(17): 5-methyl
  misc_feature (16)..(17): bicyclic nucleic acid (BNA)
aaggaagatggcatttc

SEQ ID NO: 10087 - DNA, 16 bp, Artificial Sequence
  Description of Artificial Sequence: Synthetic Antisense oligonucleotide
  misc_feature (12)..(12): 5-methyl
  misc_feature (15)..(16): bicyclic nucleic acid (BNA)
aaggaagatggcattt

SEQ ID NO: 10088 - DNA, 15 bp, Artificial Sequence
  Description of Artificial Sequence: Synthetic Antisense oligonucleotide
  misc_feature (12)..(12): 5-methyl
  misc_feature (14)..(15): bicyclic nucleic acid (BNA)
aaggaagatggcatt

SEQ ID NO: 10089 - DNA, 14 bp, Artificial Sequence
  Description of Artificial Sequence: Synthetic Antisense oligonucleotide
  misc_feature (12)..(12): 5-methyl
  misc_feature (13)..(14): bicyclic nucleic acid (BNA)
aaggaagatggcat

SEQ ID NO: 10090 - DNA, 13 bp, Artificial Sequence
  Description of Artificial Sequence: Synthetic Antisense oligonucleotide
  misc_feature (12)..(12): 5-methyl
  misc_feature (12)..(13): bicyclic nucleic acid (BNA)
aaggaagatggca

SEQ ID NO: 10091 - DNA, 12 bp, Artificial Sequence
  Description of Artificial Sequence: Synthetic Antisense oligonucleotide
  misc_feature (11)..(12): bicyclic nucleic acid (BNA)
  misc_feature (12)..(12): 5-methyl
aaggaagatggc

SEQ ID NO: 10092 - DNA, 19 bp, Artificial Sequence
  Description of Artificial Sequence: Synthetic Antisense oligonucleotide
  misc_feature (11)..(11): 5-methyl
  misc_feature (16)..(16): 5-methyl
  misc_feature (18)..(19): bicyclic nucleic acid (BNA)
aggaagatggcatttctag

SEQ ID NO: 10093 - DNA, 18 bp, Artificial Sequence
  Description of Artificial Sequence: Synthetic Antisense oligonucleotide
  misc_feature (11)..(11): 5-methyl
  misc_feature (16)..(16): 5-methyl
  misc_feature (17)..(18): bicyclic nucleic acid (BNA)
aggaagatggcatttcta

SEQ ID NO: 10094 - DNA, 17 bp, Artificial Sequence
  Description of Artificial Sequence: Synthetic Antisense oligonucleotide
  misc_feature (11)..(11): 5-methyl
  misc_feature (16)..(16): 5-methyl
  misc_feature (16)..(17): bicyclic nucleic acid (BNA)
aggaagatggcatttct

SEQ ID NO: 10095 - DNA, 16 bp, Artificial Sequence
  Description of Artificial Sequence: Synthetic Antisense oligonucleotide
  misc_feature (11)..(11): 5-methyl
  misc_feature (16)..(16): 5-methyl
  misc_feature (15)..(16): bicyclic nucleic acid (BNA)
aggaagatggcatttc

SEQ ID NO: 10096 - DNA, 15 bp, Artificial Sequence
  Description of Artificial Sequence: Synthetic Antisense oligonucleotide
  misc_feature (11)..(11): 5-methyl
  misc_feature (14)..(15): bicyclic nucleic acid (BNA)
aggaagatggcattt

SEQ ID NO: 10097 - DNA, 14 bp, Artificial Sequence
  Description of Artificial Sequence: Synthetic Antisense oligonucleotide
  misc_feature (11)..(11): 5-methyl
  misc_feature (13)..(14): bicyclic nucleic acid (BNA)
aggaagatggcatt

SEQ ID NO: 10098 - DNA, 13 bp, Artificial Sequence
  Description of Artificial Sequence: Synthetic Antisense oligonucleotide
  misc_feature (11)..(11): 5-methyl
  misc_feature (12)..(13): bicyclic nucleic acid (BNA)
aggaagatggcat

SEQ ID NO: 10099 - DNA, 12 bp, Artificial Sequence
  Description of Artificial Sequence: Synthetic Antisense oligonucleotide
  misc_feature (11)..(11): 5-methyl
  misc_feature (11)..(12): bicyclic nucleic acid (BNA)
aggaagatggca

SEQ ID NO: 10100 - DNA, 18 bp, Artificial Sequence
  Description of Artificial Sequence: Synthetic Antisense oligonucleotide
  misc_feature (10)..(10): 5-methyl
  misc_feature (15)..(15): 5-methyl
  misc_feature (17)..(18): bicyclic nucleic acid (BNA)
ggaagatggcatttctag

SEQ ID NO: 10101 - DNA, 17 bp, Artificial Sequence
  Description of Artificial Sequence: Synthetic Antisense oligonucleotide
  misc_feature (10)..(10): 5-methyl
  misc_feature (15)..(15): 5-methyl
  misc_feature (16)..(17): bicyclic nucleic acid (BNA)
ggaagatggcatttcta

SEQ ID NO: 10102 - DNA, 16 bp, Artificial Sequence
  Description of Artificial Sequence: Synthetic Antisense oligonucleotide
  misc_feature (10)..(10): 5-methyl
  misc_feature (15)..(15): 5-methyl
  misc_feature (15)..(16): bicyclic nucleic acid (BNA)
ggaagatggcatttct

SEQ ID NO: 10103 - DNA, 15 bp, Artificial Sequence
  Description of Artificial Sequence: Synthetic Antisense oligonucleotide
  misc_feature (10)..(10): 5-methyl
  misc_feature (15)..(15): 5-methyl
  misc_feature (14)..(15): bicyclic nucleic acid (BNA)
ggaagatggcatttc

SEQ ID NO: 10104 - DNA, 14 bp, Artificial Sequence
  Description of Artificial Sequence: Synthetic Antisense oligonucleotide
  misc_feature (10)..(10): 5-methyl
  misc_feature (13)..(14): bicyclic nucleic acid (BNA)
ggaagatggcattt

SEQ ID NO: 10105 - DNA, 13 bp, Artificial Sequence
  Description of Artificial Sequence: Synthetic Antisense oligonucleotide
  misc_feature (10)..(10): 5-methyl
  misc_feature (12)..(13): bicyclic nucleic acid (BNA)
ggaagatggcatt

SEQ ID NO: 10106 - DNA, 12 bp, Artificial Sequence
  Description of Artificial Sequence: Synthetic Antisense oligonucleotide
  misc_feature (10)..(10): 5-methyl
  misc_feature (11)..(12): bicyclic nucleic acid (BNA)
ggaagatggcat

SEQ ID NO: 10107 - DNA, 11 bp, Artificial Sequence
  Description of Artificial Sequence: Synthetic Antisense oligonucleotide
  misc_feature (10)..(10): 5-methyl
  misc_feature (10)..(11): bicyclic nucleic acid (BNA)
ggaagatggca

SEQ ID NO: 10108 - DNA, 10 bp, Artificial Sequence
  Description of Artificial Sequence: Synthetic Antisense oligonucleotide
  misc_feature (9)..(10): bicyclic nucleic acid (BNA)
  misc_feature (10)..(10): 5-methyl
ggaagatggc

SEQ ID NO: 10109 - DNA, 17 bp, Artificial Sequence
  Description of Artificial Sequence: Synthetic Antisense oligonucleotide
  misc_feature (9)..(9): 5-methyl
  misc_feature (14)..(14): 5-methyl
  misc_feature (16)..(17): bicyclic nucleic acid (BNA)
gaagatggcatttctag

SEQ ID NO: 10110 - DNA, 16 bp, Artificial Sequence
  Description of Artificial Sequence: Synthetic Antisense oligonucleotide
  misc_feature (9)..(9): 5-methyl
  misc_feature (14)..(14): 5-methyl
  misc_feature (15)..(16): bicyclic nucleic acid (BNA)
gaagatggcatttcta

SEQ ID NO: 10111 - DNA, 14 bp, Artificial Sequence
  Description of Artificial Sequence: Synthetic Antisense oligonucleotide
  misc_feature (9)..(9): 5-methyl
  misc_feature (14)..(14): 5-methyl
  misc_feature (13)..(14): bicyclic nucleic acid (BNA)
gaagatggcatttc

SEQ ID NO: 10112 - DNA, 13 bp, Artificial Sequence
  Description of Artificial Sequence: Synthetic Antisense oligonucleotide
  misc_feature (9)..(9): 5-methyl
  misc_feature (12)..(13): bicyclic nucleic acid (BNA)
gaagatggcattt

SEQ ID NO: 10113 - DNA, 12 bp, Artificial Sequence
  Description of Artificial Sequence: Synthetic Antisense oligonucleotide
  misc_feature (9)..(9): 5-methyl
  misc_feature (11)..(12): bicyclic nucleic acid (BNA)
gaagatggcatt

SEQ ID NO: 10114 - DNA, 11 bp, Artificial Sequence
  Description of Artificial Sequence: Synthetic Antisense oligonucleotide
  misc_feature (9)..(9): 5-methyl
  misc_feature (10)..(11): bicyclic nucleic acid (BNA)
gaagatggcat

SEQ ID NO: 10115 - DNA, 10 bp, Artificial Sequence
  Description of Artificial Sequence: Synthetic Antisense oligonucleotide
  misc_feature (9)..(9): 5-methyl
  misc_feature (9)..(10): bicyclic nucleic acid (BNA)
gaagatggca

SEQ ID NO: 10116 - DNA, 9 bp, Artificial Sequence
  Description of Artificial Sequence: Synthetic Antisense oligonucleotide
  misc_feature (8)..(9): bicyclic nucleic acid (BNA)
  misc_feature (9)..(9): 5-methyl
gaagatggc

SEQ ID NO: 10117 - DNA, 16 bp, Artificial Sequence
  Description of Artificial Sequence: Synthetic Antisense oligonucleotide
  misc_feature (8)..(8): 5-methyl
  misc_feature (13)..(13): 5-methyl
  misc_feature (15)..(16): bicyclic nucleic acid (BNA)
aagatggcatttctag

SEQ ID NO: 10118 - DNA, 15 bp, Artificial Sequence
  Description of Artificial Sequence: Synthetic Antisense oligonucleotide
  misc_feature (8)..(8): 5-methyl
  misc_feature (13)..(13): 5-methyl
  misc_feature (14)..(15): bicyclic nucleic acid (BNA)
aagatggcatttcta

SEQ ID NO: 10119 - DNA, 14 bp, Artificial Sequence
  Description of Artificial Sequence: Synthetic Antisense oligonucleotide
  misc_feature (8)..(8): 5-methyl
  misc_feature (13)..(13): 5-methyl
  misc_feature (13)..(14): bicyclic nucleic acid (BNA)
aagatggcatttct

SEQ ID NO: 10120 - DNA, 13 bp, Artificial Sequence
  Description of Artificial Sequence: Synthetic Antisense oligonucleotide
  misc_feature (8)..(8): 5-methyl
  misc_feature (13)..(13): 5-methyl
  misc_feature (12)..(13): bicyclic nucleic acid (BNA)
aagatggcatttc

SEQ ID NO: 10121 - DNA, 12 bp, Artificial Sequence
  Description of Artificial Sequence: Synthetic Antisense oligonucleotide
  misc_feature (8)..(8): 5-methyl
  misc_feature (11)..(12): bicyclic nucleic acid (BNA)
aagatggcattt

SEQ ID NO: 10122 - DNA, 11 bp, Artificial Sequence
  Description of Artificial Sequence: Synthetic Antisense oligonucleotide
  misc_feature (8)..(8): 5-methyl
  misc_feature (10)..(11): bicyclic nucleic acid (BNA)
aagatggcatt

SEQ ID NO: 10123 - DNA, 10 bp, Artificial Sequence
  Description of Artificial Sequence: Synthetic Antisense oligonucleotide
  misc_feature (8)..(8): 5-methyl
  misc_feature (9)..(10): bicyclic nucleic acid (BNA)
aagatggcat

SEQ ID NO: 10124 - DNA, 9 bp, Artificial Sequence
  Description of Artificial Sequence: Synthetic Antisense oligonucleotide
  misc_feature (8)..(8): 5-methyl
  misc_feature (8)..(9): bicyclic nucleic acid (BNA)
aagatggca

SEQ ID NO: 10125 - DNA, 8 bp, Artificial Sequence
  Description of Artificial Sequence: Synthetic Antisense oligonucleotide
  misc_feature (7)..(8): bicyclic nucleic acid (BNA)
  misc_feature (8)..(8): 5-methyl
aagatggc

SEQ ID NO: 10126 - DNA, 15 bp, Artificial Sequence
  Description of Artificial Sequence: Synthetic Antisense oligonucleotide
  misc_feature (7)..(7): 5-methyl
  misc_feature (12)..(12): 5-methyl
  misc_feature (14)..(15): bicyclic nucleic acid (BNA)
agatggcatttctag

SEQ ID NO: 10127 - DNA, 14 bp, Artificial Sequence
  Description of Artificial Sequence: Synthetic Antisense oligonucleotide
  misc_feature (7)..(7): 5-methyl
  misc_feature (12)..(12): 5-methyl
  misc_feature (13)..(14): bicyclic nucleic acid (BNA)
agatggcatttcta

SEQ ID NO: 10128 - DNA, 13 bp, Artificial Sequence
  Description of Artificial Sequence: Synthetic Antisense oligonucleotide
  misc_feature (7)..(7): 5-methyl
  misc_feature (12)..(12): 5-methyl
  misc_feature (12)..(13): bicyclic nucleic acid (BNA)
agatggcatttct

SEQ ID NO: 10129 - DNA, 12 bp, Artificial Sequence
  Description of Artificial Sequence: Synthetic Antisense oligonucleotide
  misc_feature (7)..(7): 5-methyl
  misc_feature (12)..(12): 5-methyl
  misc_feature (11)..(12): bicyclic nucleic acid (BNA)
agatggcatttc

SEQ ID NO: 10130 - DNA, 11 bp, Artificial Sequence
  Description of Artificial Sequence: Synthetic Antisense oligonucleotide
  misc_feature (7)..(7): 5-methyl
  misc_feature (10)..(11): bicyclic nucleic acid (BNA)
agatggcattt

SEQ ID NO: 10131 - DNA, 10 bp, Artificial Sequence
  Description of Artificial Sequence: Synthetic Antisense oligonucleotide
  misc_feature (7)..(7): 5-methyl
  misc_feature (9)..(10): bicyclic nucleic acid (BNA)
agatggcatt

SEQ ID NO: 10132 - DNA, 9 bp, Artificial Sequence
  Description of Artificial Sequence: Synthetic Antisense oligonucleotide
  misc_feature (7)..(7): 5-methyl
  misc_feature (8)..(9): bicyclic nucleic acid (BNA)
agatggcat

SEQ ID NO: 10133 - DNA, 8 bp, Artificial Sequence
  Description of Artificial Sequence: Synthetic Antisense oligonucleotide
  misc_feature (7)..(7): 5-methyl
  misc_feature (7)..(8): bicyclic nucleic acid (BNA)
agatggca

SEQ ID NO: 10134 - DNA, 30 bp, Artificial Sequence; identical to SEQ ID NO: 8
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (29)..(30): bicyclic nucleic acid (BNA)

SEQ ID NO: 10135 - DNA, 29 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (28)..(29): bicyclic nucleic acid (BNA)
ctccaacatcaaggaagatggcatttcta

SEQ ID NO: 10136 - DNA, 28 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (27)..(28): bicyclic nucleic acid (BNA)
ctccaacatcaaggaagatggcatttct

SEQ ID NO: 10137 - DNA, 27 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (26)..(27): bicyclic nucleic acid (BNA)
ctccaacatcaaggaagatggcatttc

SEQ ID NO: 10138 - DNA, 26 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (25)..(26): bicyclic nucleic acid (BNA)
ctccaacatcaaggaagatggcattt

SEQ ID NO: 10139 - DNA, 25 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (24)..(25): bicyclic nucleic acid (BNA)
ctccaacatcaaggaagatggcatt

SEQ ID NO: 10140 - DNA, 24 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (23)..(24): bicyclic nucleic acid (BNA)
ctccaacatcaaggaagatggcat

SEQ ID NO: 10141 - DNA, 23 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (22)..(23): bicyclic nucleic acid (BNA)
ctccaacatcaaggaagatggca

SEQ ID NO: 10142 - DNA, 22 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (21)..(22): bicyclic nucleic acid (BNA)
ctccaacatcaaggaagatggc

SEQ ID NO: 10143 - DNA, 21 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (20)..(21): bicyclic nucleic acid (BNA)
ctccaacatcaaggaagatgg

SEQ ID NO: 10144 - DNA, 20 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (19)..(20): bicyclic nucleic acid (BNA)
ctccaacatcaaggaagatg

SEQ ID NO: 10145 - DNA, 19 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (18)..(19): bicyclic nucleic acid (BNA)
ctccaacatcaaggaagat

SEQ ID NO: 10146 - DNA, 18 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (17)..(18): bicyclic nucleic acid (BNA)
ctccaacatcaaggaaga

SEQ ID NO: 10147 - DNA, 17 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (16)..(17): bicyclic nucleic acid (BNA)
ctccaacatcaaggaag

SEQ ID NO: 10148 - DNA, 29 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
  misc_feature (28)..(29): bicyclic nucleic acid (BNA)
tccaacatcaaggaagatggcatttctag

SEQ ID NO: 10149 - DNA, 28 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
  misc_feature (27)..(28): bicyclic nucleic acid (BNA)
tccaacatcaaggaagatggcatttcta

SEQ ID NO: 10150 - DNA, 27 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
  misc_feature (26)..(27): bicyclic nucleic acid (BNA)
tccaacatcaaggaagatggcatttct

SEQ ID NO: 10151 - DNA, 26 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
  misc_feature (25)..(26): bicyclic nucleic acid (BNA)
tccaacatcaaggaagatggcatttc

SEQ ID NO: 10152 - DNA, 25 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (24)..(25): bicyclic nucleic acid (BNA)
tccaacatcaaggaagatggcattt

SEQ ID NO: 10153 - DNA, 24 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (23)..(24): bicyclic nucleic acid (BNA)
tccaacatcaaggaagatggcatt

SEQ ID NO: 10154 - DNA, 23 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (22)..(23): bicyclic nucleic acid (BNA)
tccaacatcaaggaagatggcat

SEQ ID NO: 10155 - DNA, 22 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (21)..(22): bicyclic nucleic acid (BNA)
tccaacatcaaggaagatggca

SEQ ID NO: 10156 - DNA, 21 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (21)..(21): 5-methyl
  misc_feature (20)..(21): bicyclic nucleic acid (BNA)
tccaacatcaaggaagatggc

SEQ ID NO: 10157 - DNA, 20 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (19)..(20): bicyclic nucleic acid (BNA)
tccaacatcaaggaagatgg

SEQ ID NO: 10158 - DNA, 19 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (18)..(19): bicyclic nucleic acid (BNA)
tccaacatcaaggaagatg

SEQ ID NO: 10159 - DNA, 18 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (17)..(18): bicyclic nucleic acid (BNA)
tccaacatcaaggaagat

SEQ ID NO: 10160 - DNA, 17 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (16)..(17): bicyclic nucleic acid (BNA)
tccaacatcaaggaaga

SEQ ID NO: 10161 - DNA, 16 bp, Artificial Sequence
  Description of Artificial Sequence: Synthetic Antisense oligonucleotide
  misc_feature (2)..(3): 5-methyl
  misc_feature (6)..(6): 5-methyl
  misc_feature (9)..(9): 5-methyl
  misc_feature (15)..(16): bicyclic nucleic acid (BNA)
tccaacatcaaggaag

SEQ ID NO: 10162 - DNA, 28 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (27)..(28): bicyclic nucleic acid (BNA)
ccaacatcaaggaagatggcatttctag

SEQ ID NO: 10163 - DNA, 27 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (26)..(27): bicyclic nucleic acid (BNA)
ccaacatcaaggaagatggcatttcta

SEQ ID NO: 10164 - DNA, 26 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (25)..(26): bicyclic nucleic acid (BNA)
ccaacatcaaggaagatggcatttct

SEQ ID NO: 10165 - DNA, 25 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (24)..(25): bicyclic nucleic acid (BNA)
ccaacatcaaggaagatggcatttc

SEQ ID NO: 10166 - DNA, 24 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (23)..(24): bicyclic nucleic acid (BNA)
ccaacatcaaggaagatggcattt

SEQ ID NO: 10167 - DNA, 23 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (22)..(23): bicyclic nucleic acid (BNA)
ccaacatcaaggaagatggcatt

SEQ ID NO: 10168 - DNA, 22 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (21)..(22): bicyclic nucleic acid (BNA)
ccaacatcaaggaagatggcat

SEQ ID NO: 10169 - DNA, 21 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (20)..(21): bicyclic nucleic acid (BNA)
ccaacatcaaggaagatggca

SEQ ID NO: 10170 - DNA, 20 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (19)..(20): bicyclic nucleic acid (BNA)
ccaacatcaaggaagatggc

SEQ ID NO: 10171 - DNA, 19 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (18)..(19): bicyclic nucleic acid (BNA)
ccaacatcaaggaagatgg

SEQ ID NO: 10172 - DNA, 18 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (17)..(18): bicyclic nucleic acid (BNA)
ccaacatcaaggaagatg

SEQ ID NO: 10173 - DNA, 17 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (16)..(17): bicyclic nucleic acid (BNA)
ccaacatcaaggaagat

SEQ ID NO: 10174 - DNA, 16 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (15)..(16): bicyclic nucleic acid (BNA)
ccaacatcaaggaaga

SEQ ID NO: 10175 - DNA, 15 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (14)..(15): bicyclic nucleic acid (BNA)
ccaacatcaaggaag

SEQ ID NO: 10176 - DNA, 27 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (26)..(27): bicyclic nucleic acid (BNA)
caacatcaaggaagatggcatttctag

SEQ ID NO: 10177 - DNA, 26 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (25)..(26): bicyclic nucleic acid (BNA)
caacatcaaggaagatggcatttcta

SEQ ID NO: 10178 - DNA, 25 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (24)..(25): bicyclic nucleic acid (BNA)
caacatcaaggaagatggcatttct

SEQ ID NO: 10179 - DNA, 24 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (23)..(24): bicyclic nucleic acid (BNA)
caacatcaaggaagatggcatttc

SEQ ID NO: 10180 - DNA, 23 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (22)..(23): bicyclic nucleic acid (BNA)
caacatcaaggaagatggcattt

SEQ ID NO: 10181 - DNA, 22 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (21)..(22): bicyclic nucleic acid (BNA)
caacatcaaggaagatggcatt

SEQ ID NO: 10182 - DNA, 21 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (20)..(21): bicyclic nucleic acid (BNA)
caacatcaaggaagatggcat

SEQ ID NO: 10183 - DNA, 20 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (19)..(20): bicyclic nucleic acid (BNA)
caacatcaaggaagatggca

SEQ ID NO: 10184 - DNA, 19 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (18)..(19): bicyclic nucleic acid (BNA)
caacatcaaggaagatggc

SEQ ID NO: 10185 - DNA, 18 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (17)..(18): bicyclic nucleic acid (BNA)
caacatcaaggaagatgg

SEQ ID NO: 10186 - DNA, 17 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (16)..(17): bicyclic nucleic acid (BNA)
caacatcaaggaagatg

SEQ ID NO: 10187 - DNA, 16 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (15)..(16): bicyclic nucleic acid (BNA)
caacatcaaggaagat

SEQ ID NO: 10188 - DNA, 15 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (14)..(15): bicyclic nucleic acid (BNA)
caacatcaaggaaga

SEQ ID NO: 10189 - DNA, 14 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (13)..(14): bicyclic nucleic acid (BNA)
caacatcaaggaag

SEQ ID NO: 10190 - DNA, 26 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
  misc_feature (25)..(26): bicyclic nucleic acid (BNA)
aacatcaaggaagatggcatttctag

SEQ ID NO: 10191 - DNA, 25 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
  misc_feature (24)..(25): bicyclic nucleic acid (BNA)
aacatcaaggaagatggcatttcta

SEQ ID NO: 10192 - DNA, 24 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
  misc_feature (23)..(24): bicyclic nucleic acid (BNA)
aacatcaaggaagatggcatttct

SEQ ID NO: 10193 - DNA, 23 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (23)..(23): 5-methyl
  misc_feature (22)..(23): bicyclic nucleic acid (BNA)
aacatcaaggaagatggcatttc

SEQ ID NO: 10194 - DNA, 22 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (21)..(22): bicyclic nucleic acid (BNA)
aacatcaaggaagatggcattt

SEQ ID NO: 10195 - DNA, 21 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (20)..(21): bicyclic nucleic acid (BNA)
aacatcaaggaagatggcatt

SEQ ID NO: 10196 - DNA, 20 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (19)..(20): bicyclic nucleic acid (BNA)
aacatcaaggaagatggcat

SEQ ID NO: 10197 - DNA, 19 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (18)..(19): bicyclic nucleic acid (BNA)
aacatcaaggaagatggca

SEQ ID NO: 10198 - DNA, 18 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (18)..(18): 5-methyl
  misc_feature (17)..(18): bicyclic nucleic acid (BNA)
aacatcaaggaagatggc

SEQ ID NO: 10199 - DNA, 17 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (16)..(17): bicyclic nucleic acid (BNA)
aacatcaaggaagatgg

SEQ ID NO: 10200 - DNA, 16 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (15)..(16): bicyclic nucleic acid (BNA)
aacatcaaggaagatg

SEQ ID NO: 10201 - DNA, 15 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (14)..(15): bicyclic nucleic acid (BNA)
aacatcaaggaagat

SEQ ID NO: 10202 - DNA, 14 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (13)..(14): bicyclic nucleic acid (BNA)
aacatcaaggaaga

SEQ ID NO: 10203 - DNA, 13 bp, Artificial Sequence
  Description of Artificial Sequence: Synthetic Antisense oligonucleotide
  misc_feature (3)..(3): 5-methyl
  misc_feature (6)..(6): 5-methyl
  misc_feature (12)..(13): bicyclic nucleic acid (BNA)
aacatcaaggaag

SEQ ID NO: 10204 - DNA, 25 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
  misc_feature (24)..(25): bicyclic nucleic acid (BNA)
acatcaaggaagatggcatttctag

SEQ ID NO: 10205 - DNA, 24 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
  misc_feature (23)..(24): bicyclic nucleic acid (BNA)
acatcaaggaagatggcatttcta

SEQ ID NO: 10206 - DNA, 23 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
  misc_feature (22)..(23): bicyclic nucleic acid (BNA)
acatcaaggaagatggcatttct

SEQ ID NO: 10207 - DNA, 22 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (22)..(22): 5-methyl
  misc_feature (21)..(22): bicyclic nucleic acid (BNA)
acatcaaggaagatggcatttc

SEQ ID NO: 10208 - DNA, 21 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (20)..(21): bicyclic nucleic acid (BNA)
acatcaaggaagatggcattt

SEQ ID NO: 10209 - DNA, 20 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (19)..(20): bicyclic nucleic acid (BNA)
acatcaaggaagatggcatt

SEQ ID NO: 10210 - DNA, 19 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (18)..(19): bicyclic nucleic acid (BNA)
acatcaaggaagatggcat

SEQ ID NO: 10211 - DNA, 18 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (17)..(18): bicyclic nucleic acid (BNA)
acatcaaggaagatggca

SEQ ID NO: 10212 - DNA, 17 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (17)..(17): 5-methyl
  misc_feature (16)..(17): bicyclic nucleic acid (BNA)
acatcaaggaagatggc

SEQ ID NO: 10213 - DNA, 16 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (15)..(16): bicyclic nucleic acid (BNA)
acatcaaggaagatgg

SEQ ID NO: 10214 - DNA, 15 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (14)..(15): bicyclic nucleic acid (BNA)
acatcaaggaagatg

SEQ ID NO: 10215 - DNA, 14 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (13)..(14): bicyclic nucleic acid (BNA)
acatcaaggaagat

SEQ ID NO: 10216 - DNA, 13 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (12)..(13): bicyclic nucleic acid (BNA)
acatcaaggaaga

SEQ ID NO: 10217 - DNA, 12 bp, Artificial Sequence
  Description of Artificial Sequence: Synthetic Antisense oligonucleotide
  misc_feature (2)..(2): 5-methyl
  misc_feature (5)..(5): 5-methyl
  misc_feature (11)..(12): bicyclic nucleic acid (BNA)
acatcaaggaag

SEQ ID NO: 10218 - DNA, 24 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (23)..(24): bicyclic nucleic acid (BNA)
catcaaggaagatggcatttctag

SEQ ID NO: 10219 - DNA, 23 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (22)..(23): bicyclic nucleic acid (BNA)
catcaaggaagatggcatttcta

SEQ ID NO: 10220 - DNA, 22 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (21)..(22): bicyclic nucleic acid (BNA)
catcaaggaagatggcatttct

SEQ ID NO: 10221 - DNA, 21 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (20)..(21): bicyclic nucleic acid (BNA)
catcaaggaagatggcatttc

SEQ ID NO: 10222 - DNA, 20 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (19)..(20): bicyclic nucleic acid (BNA)
catcaaggaagatggcattt

SEQ ID NO: 10223 - DNA, 19 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (18)..(19): bicyclic nucleic acid (BNA)
catcaaggaagatggcatt

SEQ ID NO: 10224 - DNA, 18 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (17)..(18): bicyclic nucleic acid (BNA)
catcaaggaagatggcat

SEQ ID NO: 10225 - DNA, 17 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (16)..(17): bicyclic nucleic acid (BNA)
catcaaggaagatggca

SEQ ID NO: 10226 - DNA, 16 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (15)..(16): bicyclic nucleic acid (BNA)
catcaaggaagatggc

SEQ ID NO: 10227 - DNA, 15 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (14)..(15): bicyclic nucleic acid (BNA)
catcaaggaagatgg

SEQ ID NO: 10228 - DNA, 14 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (13)..(14): bicyclic nucleic acid (BNA)
catcaaggaagatg

SEQ ID NO: 10229 - DNA, 13 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (12)..(13): bicyclic nucleic acid (BNA)
catcaaggaagat

SEQ ID NO: 10230 - DNA, 12 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (11)..(12): bicyclic nucleic acid (BNA)
catcaaggaaga

SEQ ID NO: 10231 - DNA, 11 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (10)..(11): bicyclic nucleic acid (BNA)
catcaaggaag

SEQ ID NO: 10232 - DNA, 23 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
  misc_feature (22)..(23): bicyclic nucleic acid (BNA)
atcaaggaagatggcatttctag

SEQ ID NO: 10233 - DNA, 22 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
  misc_feature (21)..(22): bicyclic nucleic acid (BNA)
atcaaggaagatggcatttcta

SEQ ID NO: 10234 - DNA, 21 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
  misc_feature (20)..(21): bicyclic nucleic acid (BNA)
atcaaggaagatggcatttct

SEQ ID NO: 10235 - DNA, 20 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (20)..(20): 5-methyl
  misc_feature (19)..(20): bicyclic nucleic acid (BNA)
atcaaggaagatggcatttc

SEQ ID NO: 10236 - DNA, 19 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (18)..(19): bicyclic nucleic acid (BNA)
atcaaggaagatggcattt

SEQ ID NO: 10237 - DNA, 18 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (17)..(18): bicyclic nucleic acid (BNA)
atcaaggaagatggcatt

SEQ ID NO: 10238 - DNA, 17 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (16)..(17): bicyclic nucleic acid (BNA)
atcaaggaagatggcat

SEQ ID NO: 10239 - DNA, 16 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (15)..(16): bicyclic nucleic acid (BNA)
atcaaggaagatggca

SEQ ID NO: 10240 - DNA, 15 bp, Artificial Sequence
  Description of Artificial Sequence: Synthetic Antisense oligonucleotide
  misc_feature (3)..(3): 5-methyl
  misc_feature (15)..(15): 5-methyl
  misc_feature (14)..(15): bicyclic nucleic acid (BNA)
atcaaggaagatggc

SEQ ID NO: 10241 - DNA, 14 bp, Artificial Sequence
  Description of Artificial Sequence: Synthetic Antisense oligonucleotide
  misc_feature (3)..(3): 5-methyl
  misc_feature (13)..(14): bicyclic nucleic acid (BNA)
atcaaggaagatgg

SEQ ID NO: 10242 - DNA, 13 bp, Artificial Sequence
  Description of Artificial Sequence: Synthetic Antisense oligonucleotide
  misc_feature (3)..(3): 5-methyl
  misc_feature (12)..(13): bicyclic nucleic acid (BNA)
atcaaggaagatg

SEQ ID NO: 10243 - DNA, 12 bp, Artificial Sequence
  Description of Artificial Sequence: Synthetic Antisense oligonucleotide
  misc_feature (3)..(3): 5-methyl
  misc_feature (11)..(12): bicyclic nucleic acid (BNA)
atcaaggaagat

SEQ ID NO: 10244 - DNA, 11 bp, Artificial Sequence
  Description of Artificial Sequence: Synthetic Antisense oligonucleotide
  misc_feature (3)..(3): 5-methyl
  misc_feature (10)..(11): bicyclic nucleic acid (BNA)
atcaaggaaga

SEQ ID NO: 10245 - DNA, 10 bp, Artificial Sequence
  Description of Artificial Sequence: Synthetic Antisense oligonucleotide
  misc_feature (3)..(3): 5-methyl
  misc_feature (9)..(10): bicyclic nucleic acid (BNA)
atcaaggaag

SEQ ID NO: 10246 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 10247 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 10248 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 10249 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (17)..(18): bicyclic nucleic acid (BNA)
ctgtccaagcccggttga

SEQ ID NO: 10250 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (7)..(7): 5-methyl
  misc_feature (11)..(12): 5-methyl
taagttctgtccaag

SEQ ID NO: 10251 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (3)..(3): 5-methyl
  misc_feature (7)..(8): 5-methyl
  misc_feature (12)..(14): 5-methyl
ttctgtccaagcccggttga

SEQ ID NO: 10252 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (3)..(3): 5-methyl
  misc_feature (7)..(8): 5-methyl
  misc_feature (12)..(14): 5-methyl
ttctgtccaagcccggttg

SEQ ID NO: 10253 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (3)..(3): 5-methyl
  misc_feature (7)..(8): 5-methyl
  misc_feature (12)..(14): 5-methyl
ttctgtccaagcccggtt

SEQ ID NO: 10254 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (3)..(3): 5-methyl
  misc_feature (7)..(8): 5-methyl
  misc_feature (12)..(14): 5-methyl
ttctgtccaagcccggt

SEQ ID NO: 10255 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (3)..(3): 5-methyl
  misc_feature (7)..(8): 5-methyl
  misc_feature (12)..(14): 5-methyl
ttctgtccaagcccgg

SEQ ID NO: 10256 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (3)..(3): 5-methyl
  misc_feature (7)..(8): 5-methyl
  misc_feature (12)..(14): 5-methyl
ttctgtccaagcccg

SEQ ID NO: 10257 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (3)..(3): 5-methyl
  misc_feature (7)..(8): 5-methyl
  misc_feature (12)..(14): 5-methyl
ttctgtccaagccc

SEQ ID NO: 10258 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (3)..(3): 5-methyl
  misc_feature (7)..(8): 5-methyl
  misc_feature (12)..(13): 5-methyl
ttctgtccaagcc

SEQ ID NO: 10259 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (3)..(3): 5-methyl
  misc_feature (7)..(8): 5-methyl
  misc_feature (12)..(12): 5-methyl
ttctgtccaagc

SEQ ID NO: 10260 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (3)..(3): 5-methyl
  misc_feature (7)..(8): 5-methyl
ttctgtccaag

SEQ ID NO: 10261 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (3)..(3): 5-methyl
  misc_feature (7)..(8): 5-methyl
ttctgtccaa

SEQ ID NO: 10262 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
  misc_feature (3)..(3): 5-methyl
  misc_feature (7)..(8): 5-methyl
ttctgtcca

SEQ ID NO: 10263 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
  misc_feature (3)..(3): 5-methyl
  misc_feature (7)..(8): 5-methyl
ttctgtcc

SEQ ID NO: 10264 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (2)..(2): 5-methyl
  misc_feature (6)..(7): 5-methyl
  misc_feature (11)..(13): 5-methyl
tctgtccaagcccggttga

SEQ ID NO: 10265 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (2)..(2): 5-methyl
  misc_feature (6)..(7): 5-methyl
  misc_feature (11)..(13): 5-methyl
tctgtccaagcccggttg

SEQ ID NO: 10266 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (2)..(2): 5-methyl
  misc_feature (6)..(7): 5-methyl
  misc_feature (11)..(13): 5-methyl
tctgtccaagcccggtt

SEQ ID NO: 10267 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (2)..(2): 5-methyl
  misc_feature (6)..(7): 5-methyl
  misc_feature (11)..(13): 5-methyl
tctgtccaagcccggt

SEQ ID NO: 10268 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (2)..(2): 5-methyl
  misc_feature (6)..(7): 5-methyl
  misc_feature (11)..(13): 5-methyl
tctgtccaagcccgg

SEQ ID NO: 10269 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (2)..(2): 5-methyl
  misc_feature (6)..(7): 5-methyl
  misc_feature (11)..(13): 5-methyl
tctgtccaagcccg

SEQ ID NO: 10270 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (2)..(2): 5-methyl
  misc_feature (6)..(7): 5-methyl
  misc_feature (11)..(13): 5-methyl
tctgtccaagccc

SEQ ID NO: 10271 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (2)..(2): 5-methyl
  misc_feature (6)..(7): 5-methyl
  misc_feature (11)..(12): 5-methyl
tctgtccaagcc

SEQ ID NO: 10272 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (2)..(2): 5-methyl
  misc_feature (6)..(7): 5-methyl
  misc_feature (11)..(11): 5-methyl
tctgtccaagc

SEQ ID NO: 10273 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (2)..(2): 5-methyl
  misc_feature (6)..(7): 5-methyl
tctgtccaag

SEQ ID NO: 10274 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
  misc_feature (2)..(2): 5-methyl
  misc_feature (6)..(7): 5-methyl
tctgtccaa

SEQ ID NO: 10275 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
  misc_feature (2)..(2): 5-methyl
  misc_feature (6)..(7): 5-methyl
tctgtcca

SEQ ID NO: 10276 - DNA, 17 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (16)..(17): bicyclic nucleic acid (BNA)
ctgtccaagcccggttg

SEQ ID NO: 10277 - DNA, 16 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (15)..(16): bicyclic nucleic acid (BNA)
ctgtccaagcccggtt

SEQ ID NO: 10278 - DNA, 15 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (14)..(15): bicyclic nucleic acid (BNA)
ctgtccaagcccggt

SEQ ID NO: 10279 - DNA, 14 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (13)..(14): bicyclic nucleic acid (BNA)
ctgtccaagcccgg

SEQ ID NO: 10280 - DNA, 13 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (12)..(13): bicyclic nucleic acid (BNA)
ctgtccaagcccg

SEQ ID NO: 10281 - DNA, 12 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(12): bicyclic nucleic acid (BNA)
ctgtccaagccc

SEQ ID NO: 10282 - DNA, 11 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(11): 5-methyl
  misc_feature (1)..(2): bicyclic nucleic acid (BNA)
  misc_feature (10)..(11): bicyclic nucleic acid (BNA)
ctgtccaagcc

SEQ ID NO: 10283 - DNA, 10 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(10): 5-methyl
  misc_feature (1)..(2): bicyclic nucleic acid (BNA)
  misc_feature (9)..(10): bicyclic nucleic acid (BNA)
ctgtccaagc

SEQ ID NO: 10284 - DNA, 9 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (1)..(2): bicyclic nucleic acid (BNA)
  misc_feature (8)..(9): bicyclic nucleic acid (BNA)
ctgtccaag

SEQ ID NO: 10285 - DNA, 8 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (1)..(2): bicyclic nucleic acid (BNA)
  misc_feature (7)..(8): bicyclic nucleic acid (BNA)
ctgtccaa

SEQ ID NO: 10286 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (4)..(4): 5-methyl
  misc_feature (8)..(9): 5-methyl
  misc_feature (13)..(15): 5-methyl
gttctgtccaagcccggttg

SEQ ID NO: 10287 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (4)..(4): 5-methyl
  misc_feature (8)..(9): 5-methyl
  misc_feature (13)..(15): 5-methyl
gttctgtccaagcccggtt

SEQ ID NO: 10288 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (4)..(4): 5-methyl
  misc_feature (8)..(9): 5-methyl
  misc_feature (13)..(15): 5-methyl
gttctgtccaagcccggt

SEQ ID NO: 10289 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (4)..(4): 5-methyl
  misc_feature (8)..(9): 5-methyl
  misc_feature (13)..(15): 5-methyl
gttctgtccaagcccgg

SEQ ID NO: 10290 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (4)..(4): 5-methyl
  misc_feature (8)..(9): 5-methyl
  misc_feature (13)..(15): 5-methyl
gttctgtccaagcccg

SEQ ID NO: 10291 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (4)..(4): 5-methyl
  misc_feature (8)..(9): 5-methyl
  misc_feature (13)..(15): 5-methyl
gttctgtccaagccc

SEQ ID NO: 10292 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (4)..(4): 5-methyl
  misc_feature (8)..(9): 5-methyl
  misc_feature (13)..(14): 5-methyl
gttctgtccaagcc

SEQ ID NO: 10293 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (4)..(4): 5-methyl
  misc_feature (8)..(9): 5-methyl
  misc_feature (13)..(13): 5-methyl
gttctgtccaagc

SEQ ID NO: 10294 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (4)..(4): 5-methyl
  misc_feature (8)..(9): 5-methyl
gttctgtccaag

SEQ ID NO: 10295 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (4)..(4): 5-methyl
  misc_feature (8)..(9): 5-methyl
gttctgtccaa

SEQ ID NO: 10296 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (4)..(4): 5-methyl
  misc_feature (8)..(9): 5-methyl
gttctgtcca

SEQ ID NO: 10297 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
  misc_feature (4)..(4): 5-methyl
  misc_feature (8)..(9): 5-methyl
gttctgtcc

SEQ ID NO: 10298 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
  misc_feature (4)..(4): 5-methyl
  misc_feature (8)..(8): 5-methyl
gttctgtc

SEQ ID NO: 10299 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (5)..(5): 5-methyl
  misc_feature (9)..(10): 5-methyl
  misc_feature (14)..(16): 5-methyl
agttctgtccaagcccggtt

SEQ ID NO: 10300 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (5)..(5): 5-methyl
  misc_feature (9)..(10): 5-methyl
  misc_feature (14)..(16): 5-methyl
agttctgtccaagcccggt

SEQ ID NO: 10301 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (5)..(5): 5-methyl
  misc_feature (9)..(10): 5-methyl
  misc_feature (14)..(16): 5-methyl
agttctgtccaagcccgg

SEQ ID NO: 10302 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (5)..(5): 5-methyl
  misc_feature (9)..(10): 5-methyl
  misc_feature (14)..(16): 5-methyl
agttctgtccaagcccg

SEQ ID NO: 10303 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (5)..(5): 5-methyl
  misc_feature (9)..(10): 5-methyl
  misc_feature (14)..(16): 5-methyl
agttctgtccaagccc

SEQ ID NO: 10304 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (5)..(5): 5-methyl
  misc_feature (9)..(10): 5-methyl
  misc_feature (14)..(15): 5-methyl
agttctgtccaagcc

SEQ ID NO: 10305 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (5)..(5): 5-methyl
  misc_feature (9)..(10): 5-methyl
  misc_feature (14)..(14): 5-methyl
agttctgtccaagc

SEQ ID NO: 10306 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (5)..(5): 5-methyl
  misc_feature (9)..(10): 5-methyl
agttctgtccaag

SEQ ID NO: 10307 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (5)..(5): 5-methyl
  misc_feature (9)..(10): 5-methyl
agttctgtccaa

SEQ ID NO: 10308 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (5)..(5): 5-methyl
  misc_feature (9)..(10): 5-methyl
agttctgtcca

SEQ ID NO: 10309 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (5)..(5): 5-methyl
  misc_feature (9)..(10): 5-methyl
agttctgtcc

SEQ ID NO: 10310 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
  misc_feature (5)..(5): 5-methyl
  misc_feature (9)..(9): 5-methyl
agttctgtc

SEQ ID NO: 10311 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
  misc_feature (5)..(5): 5-methyl
agttctgt

SEQ ID NO: 10312 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (6)..(6): 5-methyl
  misc_feature (10)..(11): 5-methyl
  misc_feature (15)..(17): 5-methyl
aagttctgtccaagcccggt

SEQ ID NO: 10313 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (6)..(6): 5-methyl
  misc_feature (10)..(11): 5-methyl
  misc_feature (15)..(17): 5-methyl
aagttctgtccaagcccgg

SEQ ID NO: 10314 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (6)..(6): 5-methyl
  misc_feature (10)..(11): 5-methyl
  misc_feature (15)..(17): 5-methyl
aagttctgtccaagcccg

SEQ ID NO: 10315 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (6)..(6): 5-methyl
  misc_feature (10)..(11): 5-methyl
  misc_feature (15)..(17): 5-methyl
aagttctgtccaagccc

SEQ ID NO: 10316 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (6)..(6): 5-methyl
  misc_feature (10)..(11): 5-methyl
  misc_feature (15)..(16): 5-methyl
aagttctgtccaagcc

SEQ ID NO: 10317 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (6)..(6): 5-methyl
  misc_feature (10)..(11): 5-methyl
  misc_feature (15)..(15): 5-methyl
aagttctgtccaagc

SEQ ID NO: 10318 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (6)..(6): 5-methyl
  misc_feature (10)..(11): 5-methyl
aagttctgtccaag

SEQ ID NO: 10319 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (6)..(6): 5-methyl
  misc_feature (10)..(11): 5-methyl
aagttctgtccaa

SEQ ID NO: 10320 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (6)..(6): 5-methyl
  misc_feature (10)..(11): 5-methyl
aagttctgtcca

SEQ ID NO: 10321 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (6)..(6): 5-methyl
  misc_feature (10)..(11): 5-methyl
aagttctgtcc

SEQ ID NO: 10322 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (6)..(6): 5-methyl
  misc_feature (10)..(10): 5-methyl
aagttctgtc

SEQ ID NO: 10323 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
  misc_feature (6)..(6): 5-methyl
aagttctgt

SEQ ID NO: 10324 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
  misc_feature (6)..(6): 5-methyl
aagttctg

SEQ ID NO: 10325 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (7)..(7): 5-methyl
  misc_feature (11)..(12): 5-methyl
  misc_feature (16)..(18): 5-methyl
taagttctgtccaagcccgg

SEQ ID NO: 10326 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (7)..(7): 5-methyl
  misc_feature (11)..(12): 5-methyl
  misc_feature (16)..(18): 5-methyl
taagttctgtccaagcccg

SEQ ID NO: 10327 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (7)..(7): 5-methyl
  misc_feature (11)..(12): 5-methyl
  misc_feature (16)..(18): 5-methyl
taagttctgtccaagccc

SEQ ID NO: 10328 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (7)..(7): 5-methyl
  misc_feature (11)..(12): 5-methyl
  misc_feature (16)..(17): 5-methyl
taagttctgtccaagcc

SEQ ID NO: 10329 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (7)..(7): 5-methyl
  misc_feature (11)..(12): 5-methyl
  misc_feature (16)..(16): 5-methyl
taagttctgtccaagc

SEQ ID NO: 10330 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (7)..(7): 5-methyl
  misc_feature (11)..(12): 5-methyl
taagttctgtccaa

SEQ ID NO: 10331 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (7)..(7): 5-methyl
  misc_feature (11)..(12): 5-methyl
taagttctgtcca

SEQ ID NO: 10332 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (7)..(7): 5-methyl
  misc_feature (11)..(12): 5-methyl
taagttctgtcc

SEQ ID NO: 10333 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (7)..(7): 5-methyl
  misc_feature (11)..(11): 5-methyl
taagttctgtc

SEQ ID NO: 10334 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (7)..(7): 5-methyl
taagttctgt

SEQ ID NO: 10335 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
  misc_feature (7)..(7): 5-methyl
taagttctg

SEQ ID NO: 10336 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
  misc_feature (7)..(7): 5-methyl
taagttct

SEQ ID NO: 10337 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (8)..(8): 5-methyl
  misc_feature (12)..(13): 5-methyl
  misc_feature (17)..(19): 5-methyl
gtaagttctgtccaagcccg

SEQ ID NO: 10338 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (8)..(8): 5-methyl
  misc_feature (12)..(13): 5-methyl
  misc_feature (17)..(19): 5-methyl
gtaagttctgtccaagccc

SEQ ID NO: 10339 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (8)..(8): 5-methyl
  misc_feature (12)..(13): 5-methyl
  misc_feature (17)..(17): 5-methyl
gtaagttctgtccaagc

SEQ ID NO: 10340 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (8)..(8): 5-methyl
  misc_feature (12)..(13): 5-methyl
gtaagttctgtccaag

SEQ ID NO: 10341 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (8)..(8): 5-methyl
  misc_feature (12)..(13): 5-methyl
gtaagttctgtccaa

SEQ ID NO: 10342 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (8)..(8): 5-methyl
  misc_feature (12)..(13): 5-methyl
gtaagttctgtcca

SEQ ID NO: 10343 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (8)..(8): 5-methyl
  misc_feature (12)..(13): 5-methyl
gtaagttctgtcc

SEQ ID NO: 10344 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (8)..(8): 5-methyl
  misc_feature (12)..(12): 5-methyl
gtaagttctgtc

SEQ ID NO: 10345 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (8)..(8): 5-methyl
gtaagttctgt

SEQ ID NO: 10346 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (8)..(8): 5-methyl
gtaagttctg

SEQ ID NO: 10347 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
  misc_feature (8)..(8): 5-methyl
gtaagttct

SEQ ID NO: 10348 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
  misc_feature (8)..(8): 5-methyl
gtaagttc

SEQ ID NO: 10349 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (9)..(9): 5-methyl
  misc_feature (13)..(14): 5-methyl
  misc_feature (18)..(20): 5-methyl
ggtaagttctgtccaagccc

SEQ ID NO: 10350 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (9)..(9): 5-methyl
  misc_feature (13)..(14): 5-methyl
  misc_feature (18)..(19): 5-methyl
ggtaagttctgtccaagcc

SEQ ID NO: 10351 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (9)..(9): 5-methyl
  misc_feature (13)..(14): 5-methyl
ggtaagttctgtccaag

SEQ ID NO: 10352 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (9)..(9): 5-methyl
  misc_feature (13)..(14): 5-methyl
ggtaagttctgtccaa

SEQ ID NO: 10353 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (9)..(9): 5-methyl
  misc_feature (13)..(14): 5-methyl
ggtaagttctgtcca

SEQ ID NO: 10354 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (9)..(9): 5-methyl
  misc_feature (13)..(14): 5-methyl
ggtaagttctgtcc

SEQ ID NO: 10355 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (9)..(9): 5-methyl
  misc_feature (13)..(13): 5-methyl
ggtaagttctgtc

SEQ ID NO: 10356 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (9)..(9): 5-methyl
ggtaagttctgt

SEQ ID NO: 10357 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (9)..(9): 5-methyl
ggtaagttctg

SEQ ID NO: 10358 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (9)..(9): 5-methyl
ggtaagttct

SEQ ID NO: 10359 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
  misc_feature (9)..(9): 5-methyl
ggtaagttc

SEQ ID NO: 10360 - DNA, 20 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(20): 5-methyl
  misc_feature (1)..(2): bicyclic nucleic acid (BNA)
  misc_feature (19)..(20): bicyclic nucleic acid (BNA)
cggtaagttctgtccaagcc

SEQ ID NO: 10361 - DNA, 19 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (19)..(19): 5-methyl
  misc_feature (1)..(2): bicyclic nucleic acid (BNA)
  misc_feature (18)..(19): bicyclic nucleic acid (BNA)
cggtaagttctgtccaagc

SEQ ID NO: 10362 - DNA, 18 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(2): bicyclic nucleic acid (BNA)
  misc_feature (17)..(18): bicyclic nucleic acid (BNA)
cggtaagttctgtccaag

SEQ ID NO: 10363 - DNA, 17 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(2): bicyclic nucleic acid (BNA)
  misc_feature (16)..(17): bicyclic nucleic acid (BNA)
cggtaagttctgtccaa

SEQ ID NO: 10364 - DNA, 16 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(2): bicyclic nucleic acid (BNA)
  misc_feature (15)..(16): bicyclic nucleic acid (BNA)
cggtaagttctgtcca

SEQ ID NO: 10365 - DNA, 15 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(15): 5-methyl
  misc_feature (1)..(2): bicyclic nucleic acid (BNA)
  misc_feature (14)..(15): bicyclic nucleic acid (BNA)
cggtaagttctgtcc

SEQ ID NO: 10366 - DNA, 14 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (14)..(14): 5-methyl
  misc_feature (1)..(2): bicyclic nucleic acid (BNA)
  misc_feature (13)..(14): bicyclic nucleic acid (BNA)
cggtaagttctgtc

SEQ ID NO: 10367 - DNA, 13 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(2): bicyclic nucleic acid (BNA)
  misc_feature (12)..(13): bicyclic nucleic acid (BNA)
cggtaagttctgt

SEQ ID NO: 10368 - DNA, 12 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(2): bicyclic nucleic acid (BNA)
  misc_feature (11)..(12): bicyclic nucleic acid (BNA)
cggtaagttctg

SEQ ID NO: 10369 - DNA, 11 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(2): bicyclic nucleic acid (BNA)
  misc_feature (10)..(11): bicyclic nucleic acid (BNA)
cggtaagttct

SEQ ID NO: 10370 - DNA, 10 bp, Artificial Sequence
  Description of Artificial Sequence: Synthetic Antisense oligonucleotide
  misc_feature (1)..(1): 5-methyl
  misc_feature (10)..(10): 5-methyl
  misc_feature (1)..(2): bicyclic nucleic acid (BNA)
  misc_feature (9)..(10): bicyclic nucleic acid (BNA)
cggtaagttc

SEQ ID NO: 10371 - DNA, 9 bp, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
  misc_feature (8)..(9): bicyclic nucleic acid (BNA)
cggtaagtt

SEQ ID NO: 10372 - DNA, 8 bp, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
  misc_feature (7)..(8): bicyclic nucleic acid (BNA)
cggtaagt

SEQ ID NO: 10373 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (2)..(2): 5-methyl
  misc_feature (11)..(11): 5-methyl
  misc_feature (15)..(16): 5-methyl
  misc_feature (20)..(20): 5-methyl
tcggtaagttctgtccaagc

SEQ ID NO: 10374 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (2)..(2): 5-methyl
  misc_feature (11)..(11): 5-methyl
  misc_feature (15)..(16): 5-methyl
tcggtaagttctgtccaag

SEQ ID NO: 10375 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (2)..(2): 5-methyl
  misc_feature (11)..(11): 5-methyl
  misc_feature (15)..(16): 5-methyl
tcggtaagttctgtccaa

SEQ ID NO: 10376 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (2)..(2): 5-methyl
  misc_feature (11)..(11): 5-methyl
  misc_feature (15)..(16): 5-methyl
tcggtaagttctgtcca

SEQ ID NO: 10377 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (2)..(2): 5-methyl
  misc_feature (11)..(11): 5-methyl
  misc_feature (15)..(16): 5-methyl
tcggtaagttctgtcc

SEQ ID NO: 10378 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (2)..(2): 5-methyl
  misc_feature (11)..(11): 5-methyl
  misc_feature (15)..(15): 5-methyl
tcggtaagttctgtc

SEQ ID NO: 10379 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (2)..(2): 5-methyl
  misc_feature (11)..(11): 5-methyl
tcggtaagttctgt

SEQ ID NO: 10380 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (2)..(2): 5-methyl
  misc_feature (11)..(11): 5-methyl
tcggtaagttctg

SEQ ID NO: 10381 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (2)..(2): 5-methyl
  misc_feature (11)..(11): 5-methyl
tcggtaagttct

SEQ ID NO: 10382 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (2)..(2): 5-methyl
  misc_feature (11)..(11): 5-methyl
tcggtaagttc

SEQ ID NO: 10383 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (2)..(2): 5-methyl
tcggtaagtt

SEQ ID NO: 10384 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
  misc_feature (2)..(2): 5-methyl
tcggtaagt

SEQ ID NO: 10385 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (3)..(3): 5-methyl
  misc_feature (12)..(12): 5-methyl
  misc_feature (16)..(17): 5-methyl
gtcggtaagttctgtccaag

SEQ ID NO: 10386 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (3)..(3): 5-methyl
  misc_feature (12)..(12): 5-methyl
  misc_feature (16)..(17): 5-methyl
gtcggtaagttctgtccaa

SEQ ID NO: 10387 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (3)..(3): 5-methyl
  misc_feature (12)..(12): 5-methyl
  misc_feature (16)..(17): 5-methyl
gtcggtaagttctgtcca

SEQ ID NO: 10388 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (3)..(3): 5-methyl
  misc_feature (12)..(12): 5-methyl
  misc_feature (16)..(17): 5-methyl
gtcggtaagttctgtcc

SEQ ID NO: 10389 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (3)..(3): 5-methyl
  misc_feature (12)..(12): 5-methyl
  misc_feature (16)..(16): 5-methyl
gtcggtaagttctgtc

SEQ ID NO: 10390 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (3)..(3): 5-methyl
  misc_feature (12)..(12): 5-methyl
gtcggtaagttctgt

SEQ ID NO: 10391 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (3)..(3): 5-methyl
  misc_feature (12)..(12): 5-methyl
gtcggtaagttctg

SEQ ID NO: 10392 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (3)..(3): 5-methyl
  misc_feature (12)..(12): 5-methyl
gtcggtaagttct

SEQ ID NO: 10393 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (3)..(3): 5-methyl
  misc_feature (12)..(12): 5-methyl
gtcggtaagttc

SEQ ID NO: 10394 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (3)..(3): 5-methyl
gtcggtaagtt

SEQ ID NO: 10395 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (3)..(3): 5-methyl
gtcggtaagt

SEQ ID NO: 10396 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (4)..(4): 5-methyl
  misc_feature (13)..(13): 5-methyl
  misc_feature (17)..(18): 5-methyl
agtcggtaagttctgtccaa

SEQ ID NO: 10397 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcca

SEQ ID NO: 10398 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (4)..(4): 5-methyl
  misc_feature (13)..(13): 5-methyl
  misc_feature (17)..(17): 5-methyl
agtcggtaagttctgtc

SEQ ID NO: 10399 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (4)..(4): 5-methyl
  misc_feature (13)..(13): 5-methyl
agtcggtaagttctgt

SEQ ID NO: 10400 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (4)..(4): 5-methyl
  misc_feature (13)..(13): 5-methyl
agtcggtaagttctg

SEQ ID NO: 10401 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (4)..(4): 5-methyl
  misc_feature (13)..(13): 5-methyl
agtcggtaagttct

SEQ ID NO: 10402 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (4)..(4): 5-methyl
  misc_feature (13)..(13): 5-methyl
agtcggtaagttc

SEQ ID NO: 10403 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (4)..(4): 5-methyl
agtcggtaagtt

SEQ ID NO: 10404 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (4)..(4): 5-methyl
agtcggtaagt

SEQ ID NO: 10405 - DNA, 20 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (1)..(2): bicyclic nucleic acid (BNA)
  misc_feature (19)..(20): bicyclic nucleic acid (BNA)
cagtcggtaagttctgtcca

SEQ ID NO: 10406 - DNA, 19 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(19): 5-methyl
  misc_feature (1)..(2): bicyclic nucleic acid (BNA)
  misc_feature (18)..(19): bicyclic nucleic acid (BNA)
cagtcggtaagttctgtcc

SEQ ID NO: 10407 - DNA, 18 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (18)..(18): 5-methyl
  misc_feature (1)..(2): bicyclic nucleic acid (BNA)
  misc_feature (17)..(18): bicyclic nucleic acid (BNA)
cagtcggtaagttctgtc

SEQ ID NO: 10408 - DNA, 17 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(2): bicyclic nucleic acid (BNA)
  misc_feature (16)..(17): bicyclic nucleic acid (BNA)
cagtcggtaagttctgt

SEQ ID NO: 10409 - DNA, 16 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(2): bicyclic nucleic acid (BNA)
  misc_feature (15)..(16): bicyclic nucleic acid (BNA)
cagtcggtaagttctg

SEQ ID NO: 10410 - DNA, 15 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(2): bicyclic nucleic acid (BNA)
  misc_feature (14)..(15): bicyclic nucleic acid (BNA)
cagtcggtaagttct

SEQ ID NO: 10411 - DNA, 14 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (14)..(14): 5-methyl
  misc_feature (1)..(2): bicyclic nucleic acid (BNA)
  misc_feature (13)..(14): bicyclic nucleic acid (BNA)
cagtcggtaagttc

SEQ ID NO: 10412 - DNA, 13 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (1)..(2): bicyclic nucleic acid (BNA)
  misc_feature (12)..(13): bicyclic nucleic acid (BNA)
cagtcggtaagtt

SEQ ID NO: 10413 - DNA, 12 bp, Artificial Sequence
  Description of Artificial Sequence: Synthetic Antisense oligonucleotide
  misc_feature (1)..(1): 5-methyl
  misc_feature (5)..(5): 5-methyl
  misc_feature (1)..(2): bicyclic nucleic acid (BNA)
  misc_feature (11)..(12): bicyclic nucleic acid (BNA)
cagtcggtaagt

SEQ ID NO: 10414 - DNA, 20 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(20): 5-methyl
  misc_feature (1)..(2): bicyclic nucleic acid (BNA)
  misc_feature (19)..(20): bicyclic nucleic acid (BNA)
ccagtcggtaagttctgtcc

SEQ ID NO: 10415 - DNA, 19 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (19)..(19): 5-methyl
  misc_feature (1)..(2): bicyclic nucleic acid (BNA)
  misc_feature (18)..(19): bicyclic nucleic acid (BNA)
ccagtcggtaagttctgtc

SEQ ID NO: 10416 - DNA, 18 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(2): bicyclic nucleic acid (BNA)
  misc_feature (17)..(18): bicyclic nucleic acid (BNA)
ccagtcggtaagttctgt

SEQ ID NO: 10417 - DNA, 17 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(2): bicyclic nucleic acid (BNA)
  misc_feature (16)..(17): bicyclic nucleic acid (BNA)
ccagtcggtaagttctg

SEQ ID NO: 10418 - DNA, 16 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(2): bicyclic nucleic acid (BNA)
  misc_feature (15)..(16): bicyclic nucleic acid (BNA)
ccagtcggtaagttct

SEQ ID NO: 10419 - DNA, 15 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (15)..(15): 5-methyl
  misc_feature (1)..(2): bicyclic nucleic acid (BNA)
  misc_feature (14)..(15): bicyclic nucleic acid (BNA)
ccagtcggtaagttc

SEQ ID NO: 10420 - DNA, 14 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (1)..(2): bicyclic nucleic acid (BNA)
  misc_feature (13)..(14): bicyclic nucleic acid (BNA)
ccagtcggtaagtt

SEQ ID NO: 10421 - DNA, 13 bp, Artificial Sequence
  Description of Artificial Sequence: Synthetic Antisense oligonucleotide
  misc_feature (1)..(2): 5-methyl
  misc_feature (6)..(6): 5-methyl
  misc_feature (1)..(2): bicyclic nucleic acid (BNA)
  misc_feature (12)..(13): bicyclic nucleic acid (BNA)
ccagtcggtaagt

SEQ ID NO: 10422 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (2)..(3): 5-methyl
  misc_feature (7)..(7): 5-methyl
  misc_feature (16)..(16): 5-methyl
  misc_feature (20)..(20): 5-methyl
gccagtcggtaagttctgtc

SEQ ID NO: 10423 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (2)..(3): 5-methyl
  misc_feature (7)..(7): 5-methyl
  misc_feature (16)..(16): 5-methyl
gccagtcggtaagttctgt

SEQ ID NO: 10424 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (2)..(3): 5-methyl
  misc_feature (7)..(7): 5-methyl
  misc_feature (16)..(16): 5-methyl
gccagtcggtaagttctg

SEQ ID NO: 10425 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (2)..(3): 5-methyl
  misc_feature (7)..(7): 5-methyl
  misc_feature (16)..(16): 5-methyl
gccagtcggtaagttct

SEQ ID NO: 10426 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (2)..(3): 5-methyl
  misc_feature (7)..(7): 5-methyl
  misc_feature (16)..(16): 5-methyl
gccagtcggtaagttc

SEQ ID NO: 10427 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (2)..(3): 5-methyl
  misc_feature (7)..(7): 5-methyl
gccagtcggtaagtt

SEQ ID NO: 10428 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (2)..(3): 5-methyl
  misc_feature (7)..(7): 5-methyl
gccagtcggtaagt

SEQ ID NO: 10429 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 10430 - DNA, 22 bp, Artificial Sequence
  Description of Artificial Sequence: Synthetic Antisense oligonucleotide
  misc_feature (1)..(2): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 10431 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (2)..(2): 5-methyl
  misc_feature (14)..(14): 5-methyl
tcaaggaagatggcat

SEQ ID NO: 10432 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (9)..(9): 5-methyl
  misc_feature (14)..(14): 5-methyl
gaagatggcatttct

SEQ ID NO: 10433 - DNA, 21 bp, Artificial Sequence
  Description of Artificial Sequence: Synthetic Antisense oligonucleotide
  misc_feature (1)..(2): bicyclic nucleic acid (BNA)
  misc_feature (20)..(21): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttcta

SEQ ID NO: 10434 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttc

SEQ ID NO: 10435 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (2)..(2): 5-methyl
  misc_feature (14)..(14): 5-methyl
tcaaggaagatggcattt

SEQ ID NO: 10436 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (2)..(2): 5-methyl
  misc_feature (14)..(14): 5-methyl
tcaaggaagatggcatt

SEQ ID NO: 10437 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (2)..(2): 5-methyl
  misc_feature (14)..(14): 5-methyl
tcaaggaagatggca

SEQ ID NO: 10438 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (2)..(2): 5-methyl
  misc_feature (14)..(14): 5-methyl
tcaaggaagatggc

SEQ ID NO: 10439 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (2)..(2): 5-methyl
tcaaggaagatgg

SEQ ID NO: 10440 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (2)..(2): 5-methyl
tcaaggaagatg

SEQ ID NO: 10441 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (2)..(2): 5-methyl
tcaaggaagat

SEQ ID NO: 10442 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (2)..(2): 5-methyl
tcaaggaaga

SEQ ID NO: 10443 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
  misc_feature (2)..(2): 5-methyl
tcaaggaag

SEQ ID NO: 10444 - DNA, 21 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(2): bicyclic nucleic acid (BNA)
  misc_feature (20)..(21): bicyclic nucleic acid (BNA)
caaggaagatggcatttctag

SEQ ID NO: 10445 - DNA, 20 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(2): bicyclic nucleic acid (BNA)
  misc_feature (19)..(20): bicyclic nucleic acid (BNA)
caaggaagatggcatttcta

SEQ ID NO: 10446 - DNA, 19 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(2): bicyclic nucleic acid (BNA)
  misc_feature (18)..(19): bicyclic nucleic acid (BNA)
caaggaagatggcatttct

SEQ ID NO: 10447 - DNA, 18 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (18)..(18): 5-methyl
  misc_feature (1)..(2): bicyclic nucleic acid (BNA)
  misc_feature (17)..(18): bicyclic nucleic acid (BNA)
caaggaagatggcatttc

SEQ ID NO: 10448 - DNA, 17 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(2): bicyclic nucleic acid (BNA)
  misc_feature (16)..(17): bicyclic nucleic acid (BNA)
caaggaagatggcattt

SEQ ID NO: 10449 - DNA, 16 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(2): bicyclic nucleic acid (BNA)
  misc_feature (15)..(16): bicyclic nucleic acid (BNA)
caaggaagatggcatt

SEQ ID NO: 10450 - DNA, 15 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(2): bicyclic nucleic acid (BNA)
  misc_feature (14)..(15): bicyclic nucleic acid (BNA)
caaggaagatggcat

SEQ ID NO: 10451 - DNA, 14 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(2): bicyclic nucleic acid (BNA)
  misc_feature (13)..(14): bicyclic nucleic acid (BNA)
caaggaagatggca

SEQ ID NO: 10452 - DNA, 13 bp, Artificial Sequence
  Description of Artificial Sequence: Synthetic Antisense oligonucleotide
  misc_feature (1)..(1): 5-methyl
  misc_feature (13)..(13): 5-methyl
  misc_feature (1)..(2): bicyclic nucleic acid (BNA)
  misc_feature (12)..(13): bicyclic nucleic acid (BNA)
caaggaagatggc

SEQ ID NO: 10453 - DNA, 12 bp, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
  misc_feature (11)..(12): bicyclic nucleic acid (BNA)
caaggaagatgg

SEQ ID NO: 10454 - DNA, 11 bp, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
  misc_feature (10)..(11): bicyclic nucleic acid (BNA)
caaggaagatg

SEQ ID NO: 10455 - DNA, 10 bp, Artificial Sequence
  Description of Artificial Sequence: Synthetic Antisense oligonucleotide
  misc_feature (1)..(1): 5-methyl
  misc_feature (1)..(2): bicyclic nucleic acid (BNA)
  misc_feature (9)..(10): bicyclic nucleic acid (BNA)
caaggaagat

SEQ ID NO: 10456 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (12)..(12): 5-methyl
  misc_feature (17)..(17): 5-methyl
aaggaagatggcatttctag

SEQ ID NO: 10457 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (12)..(12): 5-methyl
  misc_feature (17)..(17): 5-methyl
aaggaagatggcatttcta

SEQ ID NO: 10458 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (12)..(12): 5-methyl
  misc_feature (17)..(17): 5-methyl
aaggaagatggcatttct

SEQ ID NO: 10459 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (12)..(12): 5-methyl
  misc_feature (17)..(17): 5-methyl
aaggaagatggcatttc

SEQ ID NO: 10460 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (12)..(12): 5-methyl
aaggaagatggcattt

SEQ ID NO: 10461 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (12)..(12): 5-methyl
aaggaagatggcatt

SEQ ID NO: 10462 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (12)..(12): 5-methyl
aaggaagatggcat

SEQ ID NO: 10463 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (12)..(12): 5-methyl
aaggaagatggca

SEQ ID NO: 10464 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (12)..(12): 5-methyl
aaggaagatggc

SEQ ID NO: 10465 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (11)..(11): 5-methyl
  misc_feature (16)..(16): 5-methyl
aggaagatggcatttctag

SEQ ID NO: 10466 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (11)..(11): 5-methyl
  misc_feature (16)..(16): 5-methyl
aggaagatggcatttcta

SEQ ID NO: 10467 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (11)..(11): 5-methyl
  misc_feature (16)..(16): 5-methyl
aggaagatggcatttct

SEQ ID NO: 10468 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (11)..(11): 5-methyl
  misc_feature (16)..(16): 5-methyl
aggaagatggcatttc

SEQ ID NO: 10469 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (11)..(11): 5-methyl
aggaagatggcattt

SEQ ID NO: 10470 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (11)..(11): 5-methyl
aggaagatggcatt

SEQ ID NO: 10471 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (11)..(11): 5-methyl
aggaagatggcat

SEQ ID NO: 10472 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (11)..(11): 5-methyl
aggaagatggca

SEQ ID NO: 10473 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (10)..(10): 5-methyl
  misc_feature (15)..(15): 5-methyl
ggaagatggcatttctag

SEQ ID NO: 10474 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (10)..(10): 5-methyl
  misc_feature (15)..(15): 5-methyl
ggaagatggcatttcta

SEQ ID NO: 10475 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (10)..(10): 5-methyl
  misc_feature (15)..(15): 5-methyl
ggaagatggcatttct

SEQ ID NO: 10476 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (10)..(10): 5-methyl
  misc_feature (15)..(15): 5-methyl
ggaagatggcatttc

SEQ ID NO: 10477 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (10)..(10): 5-methyl
ggaagatggcattt

SEQ ID NO: 10478 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (10)..(10): 5-methyl
ggaagatggcatt

SEQ ID NO: 10479 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (10)..(10): 5-methyl
ggaagatggcat

SEQ ID NO: 10480 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (10)..(10): 5-methyl
ggaagatggca

SEQ ID NO: 10481 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (10)..(10): 5-methyl
ggaagatggc

SEQ ID NO: 10482 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (9)..(9): 5-methyl
  misc_feature (14)..(14): 5-methyl
gaagatggcatttctag

SEQ ID NO: 10483 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (9)..(9): 5-methyl
  misc_feature (14)..(14): 5-methyl
gaagatggcatttcta

SEQ ID NO: 10484 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (9)..(9): 5-methyl
  misc_feature (14)..(14): 5-methyl
gaagatggcatttc

SEQ ID NO: 10485 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (9)..(9): 5-methyl
gaagatggcattt

SEQ ID NO: 10486 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (9)..(9): 5-methyl
gaagatggcatt

SEQ ID NO: 10487 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (9)..(9): 5-methyl
gaagatggcat

SEQ ID NO: 10488 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (9)..(9): 5-methyl
gaagatggca

SEQ ID NO: 10489 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
  misc_feature (9)..(9): 5-methyl
gaagatggc

SEQ ID NO: 10490 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (8)..(8): 5-methyl
  misc_feature (13)..(13): 5-methyl
aagatggcatttctag

SEQ ID NO: 10491 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (8)..(8): 5-methyl
  misc_feature (13)..(13): 5-methyl
aagatggcatttcta

SEQ ID NO: 10492 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (8)..(8): 5-methyl
  misc_feature (13)..(13): 5-methyl
aagatggcatttct

SEQ ID NO: 10493 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (8)..(8): 5-methyl
  misc_feature (13)..(13): 5-methyl
aagatggcatttc

SEQ ID NO: 10494 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (8)..(8): 5-methyl
aagatggcattt

SEQ ID NO: 10495 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (8)..(8): 5-methyl
aagatggcatt

SEQ ID NO: 10496 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (8)..(8): 5-methyl
aagatggcat

SEQ ID NO: 10497 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
  misc_feature (8)..(8): 5-methyl
aagatggca

SEQ ID NO: 10498 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
  misc_feature (8)..(8): 5-methyl
aagatggc

SEQ ID NO: 10499 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (7)..(7): 5-methyl
  misc_feature (12)..(12): 5-methyl
agatggcatttctag

SEQ ID NO: 10500 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (7)..(7): 5-methyl
  misc_feature (12)..(12): 5-methyl
agatggcatttcta

SEQ ID NO: 10501 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (7)..(7): 5-methyl
  misc_feature (12)..(12): 5-methyl
agatggcatttct

SEQ ID NO: 10502 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (7)..(7): 5-methyl
  misc_feature (12)..(12): 5-methyl
agatggcatttc

SEQ ID NO: 10503 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (7)..(7): 5-methyl
agatggcattt

SEQ ID NO: 10504 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (7)..(7): 5-methyl
agatggcatt

SEQ ID NO: 10505 - DNA, 9 bp, Artificial Sequence
  Description of Artificial Sequence: Synthetic Antisense oligonucleotide
  misc_feature (1)..(2): bicyclic nucleic acid (BNA)
  misc_feature (8)..(9): bicyclic nucleic acid (BNA)
  misc_feature (7)..(7): 5-methyl
agatggcat

SEQ ID NO: 10506 - DNA, 8 bp, Artificial Sequence
  Description of Artificial Sequence: Synthetic Antisense oligonucleotide
  misc_feature (1)..(2): bicyclic nucleic acid (BNA)
  misc_feature (7)..(8): bicyclic nucleic acid (BNA)
  misc_feature (7)..(7): 5-methyl
agatggca

SEQ ID NO: 10507 - DNA, 30 bp, Artificial Sequence; identical to SEQ ID NO: 8
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(2): bicyclic nucleic acid (BNA)
  misc_feature (29)..(30): bicyclic nucleic acid (BNA)

SEQ ID NO: 10508 - DNA, 29 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(2): bicyclic nucleic acid (BNA)
  misc_feature (28)..(29): bicyclic nucleic acid (BNA)
ctccaacatcaaggaagatggcatttcta

SEQ ID NO: 10509 - DNA, 28 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(2): bicyclic nucleic acid (BNA)
  misc_feature (27)..(28): bicyclic nucleic acid (BNA)
ctccaacatcaaggaagatggcatttct

SEQ ID NO: 10510 - DNA, 27 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (27)..(27): 5-methyl
  misc_feature (1)..(2): bicyclic nucleic acid (BNA)
  misc_feature (26)..(27): bicyclic nucleic acid (BNA)
ctccaacatcaaggaagatggcatttc

SEQ ID NO: 10511 - DNA, 26 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
  misc_feature (25)..(26): bicyclic nucleic acid (BNA)
ctccaacatcaaggaagatggcattt

SEQ ID NO: 10512 - DNA, 25 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
  misc_feature (24)..(25): bicyclic nucleic acid (BNA)
ctccaacatcaaggaagatggcatt

SEQ ID NO: 10513 - DNA, 24 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
  misc_feature (23)..(24): bicyclic nucleic acid (BNA)
ctccaacatcaaggaagatggcat

SEQ ID NO: 10514 - DNA, 23 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
  misc_feature (22)..(23): bicyclic nucleic acid (BNA)
ctccaacatcaaggaagatggca

SEQ ID NO: 10515 - DNA, 22 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (22)..(22): 5-methyl
  misc_feature (1)..(2): bicyclic nucleic acid (BNA)
  misc_feature (21)..(22): bicyclic nucleic acid (BNA)
ctccaacatcaaggaagatggc

SEQ ID NO: 10516 - DNA, 21 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
  misc_feature (20)..(21): bicyclic nucleic acid (BNA)
ctccaacatcaaggaagatgg

SEQ ID NO: 10517 - DNA, 20 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
  misc_feature (19)..(20): bicyclic nucleic acid (BNA)
ctccaacatcaaggaagatg

SEQ ID NO: 10518 - DNA, 19 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
  misc_feature (18)..(19): bicyclic nucleic acid (BNA)
ctccaacatcaaggaagat

SEQ ID NO: 10519 - DNA, 18 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
  misc_feature (17)..(18): bicyclic nucleic acid (BNA)
ctccaacatcaaggaaga

SEQ ID NO: 10520 - DNA, 17 bp, Artificial Sequence
  Description of Artificial Sequence: Synthetic Antisense oligonucleotide
  misc_feature (1)..(1): 5-methyl
  misc_feature (3)..(4): 5-methyl
  misc_feature (7)..(7): 5-methyl
  misc_feature (10)..(10): 5-methyl
  misc_feature (1)..(2): bicyclic nucleic acid (BNA)
  misc_feature (16)..(17): bicyclic nucleic acid (BNA)
ctccaacatcaaggaag

SEQ ID NO: 10521 - DNA, 29 bp, Artificial Sequence
  Description of Artificial Sequence: Synthetic Antisense oligonucleotide
  misc_feature (1)..(2): bicyclic nucleic acid (BNA)
  misc_feature (28)..(29): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttctag

SEQ ID NO: 10522 - DNA, 28 bp, Artificial Sequence
  Description of Artificial Sequence: Synthetic Antisense oligonucleotide
  misc_feature (1)..(2): bicyclic nucleic acid (BNA)
  misc_feature (27)..(28): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttcta

SEQ ID NO: 10523 - DNA, 27 bp, Artificial Sequence
  Description of Artificial Sequence: Synthetic Antisense oligonucleotide
  misc_feature (1)..(2): bicyclic nucleic acid (BNA)
  misc_feature (26)..(27): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttct

SEQ ID NO: 10524 - DNA, 26 bp, Artificial Sequence
  Description of Artificial Sequence: Synthetic Antisense oligonucleotide
  misc_feature (1)..(2): bicyclic nucleic acid (BNA)
  misc_feature (25)..(26): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
  misc_feature (26)..(26): 5-methyl
tccaacatcaaggaagatggcatttc

SEQ ID NO: 10525 - DNA, 25 bp, Artificial Sequence
  Description of Artificial Sequence: Synthetic Antisense oligonucleotide
  misc_feature (1)..(2): bicyclic nucleic acid (BNA)
  misc_feature (24)..(25): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggcattt

SEQ ID NO: 10526 - DNA, 24 bp, Artificial Sequence
  Description of Artificial Sequence: Synthetic Antisense oligonucleotide
  misc_feature (1)..(2): bicyclic nucleic acid (BNA)
  misc_feature (23)..(24): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggcatt

SEQ ID NO: 10527 - DNA, 23 bp, Artificial Sequence
  Description of Artificial Sequence: Synthetic Antisense oligonucleotide
  misc_feature (1)..(2): bicyclic nucleic acid (BNA)
  misc_feature (22)..(23): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggcat

SEQ ID NO: 10528 - DNA, 22 bp, Artificial Sequence
  Description of Artificial Sequence: Synthetic Antisense oligonucleotide
  misc_feature (1)..(2): bicyclic nucleic acid (BNA)
  misc_feature (21)..(22): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggca

SEQ ID NO: 10529 - DNA, 21 bp, Artificial Sequence
  Description of Artificial Sequence: Synthetic Antisense oligonucleotide
  misc_feature (1)..(2): bicyclic nucleic acid (BNA)
  misc_feature (20)..(21): bicyclic nucleic acid (BNA)
  misc_feature (2)..(3): 5-methyl
  misc_feature (6)..(6): 5-methyl
  misc_feature (9)..(9): 5-methyl
  misc_feature (21)..(21): 5-methyl
tccaacatcaaggaagatggc

SEQ ID NO: 10530 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (2)..(3): 5-methyl
  misc_feature (6)..(6): 5-methyl
  misc_feature (9)..(9): 5-methyl
tccaacatcaaggaagatgg

SEQ ID NO: 10531 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (2)..(3): 5-methyl
  misc_feature (6)..(6): 5-methyl
  misc_feature (9)..(9): 5-methyl
tccaacatcaaggaagatg

SEQ ID NO: 10532 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (2)..(3): 5-methyl
  misc_feature (6)..(6): 5-methyl
  misc_feature (9)..(9): 5-methyl
tccaacatcaaggaagat

SEQ ID NO: 10533 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (2)..(3): 5-methyl
  misc_feature (6)..(6): 5-methyl
  misc_feature (9)..(9): 5-methyl
tccaacatcaaggaaga

SEQ ID NO: 10534 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (2)..(3): 5-methyl
  misc_feature (6)..(6): 5-methyl
  misc_feature (9)..(9): 5-methyl
tccaacatcaaggaag

SEQ ID NO: 10535 - DNA, 28 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(2): bicyclic nucleic acid (BNA)
  misc_feature (27)..(28): bicyclic nucleic acid (BNA)
ccaacatcaaggaagatggcatttctag

SEQ ID NO: 10536 - DNA, 27 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(2): bicyclic nucleic acid (BNA)
  misc_feature (26)..(27): bicyclic nucleic acid (BNA)
ccaacatcaaggaagatggcatttcta

SEQ ID NO: 10537 - DNA, 26 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(2): bicyclic nucleic acid (BNA)
  misc_feature (25)..(26): bicyclic nucleic acid (BNA)
ccaacatcaaggaagatggcatttct

SEQ ID NO: 10538 - DNA, 25 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (25)..(25): 5-methyl
  misc_feature (1)..(2): bicyclic nucleic acid (BNA)
  misc_feature (24)..(25): bicyclic nucleic acid (BNA)
ccaacatcaaggaagatggcatttc

SEQ ID NO: 10539 - DNA, 24 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
  misc_feature (23)..(24): bicyclic nucleic acid (BNA)
ccaacatcaaggaagatggcattt

SEQ ID NO: 10540 - DNA, 23 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
  misc_feature (22)..(23): bicyclic nucleic acid (BNA)
ccaacatcaaggaagatggcatt

SEQ ID NO: 10541 - DNA, 22 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
  misc_feature (21)..(22): bicyclic nucleic acid (BNA)
ccaacatcaaggaagatggcat

SEQ ID NO: 10542 - DNA, 21 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
  misc_feature (20)..(21): bicyclic nucleic acid (BNA)
ccaacatcaaggaagatggca

SEQ ID NO: 10543 - DNA, 20 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (20)..(20): 5-methyl
  misc_feature (1)..(2): bicyclic nucleic acid (BNA)
  misc_feature (19)..(20): bicyclic nucleic acid (BNA)
ccaacatcaaggaagatggc

SEQ ID NO: 10544 - DNA, 19 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
  misc_feature (18)..(19): bicyclic nucleic acid (BNA)
ccaacatcaaggaagatgg

SEQ ID NO: 10545 - DNA, 18 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
  misc_feature (17)..(18): bicyclic nucleic acid (BNA)
ccaacatcaaggaagatg

SEQ ID NO: 10546 - DNA, 17 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
  misc_feature (16)..(17): bicyclic nucleic acid (BNA)
ccaacatcaaggaagat

SEQ ID NO: 10547 - DNA, 16 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
  misc_feature (15)..(16): bicyclic nucleic acid (BNA)
ccaacatcaaggaaga

SEQ ID NO: 10548 - DNA, 15 bp, Artificial Sequence
  Description of Artificial Sequence: Synthetic Antisense oligonucleotide
  misc_feature (1)..(2): 5-methyl
  misc_feature (5)..(5): 5-methyl
  misc_feature (8)..(8): 5-methyl
  misc_feature (1)..(2): bicyclic nucleic acid (BNA)
  misc_feature (14)..(15): bicyclic nucleic acid (BNA)
ccaacatcaaggaag

SEQ ID NO: 10549 - DNA, 27 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(2): bicyclic nucleic acid (BNA)
  misc_feature (26)..(27): bicyclic nucleic acid (BNA)
caacatcaaggaagatggcatttctag

SEQ ID NO: 10550 - DNA, 26 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(2): bicyclic nucleic acid (BNA)
  misc_feature (25)..(26): bicyclic nucleic acid (BNA)
caacatcaaggaagatggcatttcta

SEQ ID NO: 10551 - DNA, 25 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(2): bicyclic nucleic acid (BNA)
  misc_feature (24)..(25): bicyclic nucleic acid (BNA)
caacatcaaggaagatggcatttct

SEQ ID NO: 10552 - DNA, 24 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (24)..(24): 5-methyl
  misc_feature (1)..(2): bicyclic nucleic acid (BNA)
  misc_feature (23)..(24): bicyclic nucleic acid (BNA)
caacatcaaggaagatggcatttc

SEQ ID NO: 10553 - DNA, 23 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
  misc_feature (22)..(23): bicyclic nucleic acid (BNA)
caacatcaaggaagatggcattt

SEQ ID NO: 10554 - DNA, 22 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
  misc_feature (21)..(22): bicyclic nucleic acid (BNA)
caacatcaaggaagatggcatt

SEQ ID NO: 10555 - DNA, 21 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
  misc_feature (20)..(21): bicyclic nucleic acid (BNA)
caacatcaaggaagatggcat

SEQ ID NO: 10556 - DNA, 20 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
  misc_feature (19)..(20): bicyclic nucleic acid (BNA)
caacatcaaggaagatggca

SEQ ID NO: 10557 - DNA, 19 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (19)..(19): 5-methyl
  misc_feature (1)..(2): bicyclic nucleic acid (BNA)
  misc_feature (18)..(19): bicyclic nucleic acid (BNA)
caacatcaaggaagatggc

SEQ ID NO: 10558 - DNA, 18 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
  misc_feature (17)..(18): bicyclic nucleic acid (BNA)
caacatcaaggaagatgg

SEQ ID NO: 10559 - DNA, 17 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
  misc_feature (16)..(17): bicyclic nucleic acid (BNA)
caacatcaaggaagatg

SEQ ID NO: 10560 - DNA, 16 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
  misc_feature (15)..(16): bicyclic nucleic acid (BNA)
caacatcaaggaagat

SEQ ID NO: 10561 - DNA, 15 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
  misc_feature (14)..(15): bicyclic nucleic acid (BNA)
caacatcaaggaaga

SEQ ID NO: 10562 - DNA, 14 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (7)..(7): 5-methyl
  misc_feature (1)..(2): bicyclic nucleic acid (BNA)
  misc_feature (13)..(14): bicyclic nucleic acid (BNA)
caacatcaaggaag

SEQ ID NO: 10563 - DNA, 26 bp, Artificial Sequence
  Description of Artificial Sequence: Synthetic Antisense oligonucleotide
  misc_feature (1)..(2): bicyclic nucleic acid (BNA)
  misc_feature (25)..(26): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttctag

SEQ ID NO: 10564 - DNA, 25 bp, Artificial Sequence
  Description of Artificial Sequence: Synthetic Antisense oligonucleotide
  misc_feature (1)..(2): bicyclic nucleic acid (BNA)
  misc_feature (24)..(25): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttcta

SEQ ID NO: 10565 - DNA, 24 bp, Artificial Sequence
  Description of Artificial Sequence: Synthetic Antisense oligonucleotide
  misc_feature (1)..(2): bicyclic nucleic acid (BNA)
  misc_feature (23)..(24): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttct

SEQ ID NO: 10566 - DNA, 23 bp, Artificial Sequence
  Description of Artificial Sequence: Synthetic Antisense oligonucleotide
  misc_feature (1)..(2): bicyclic nucleic acid (BNA)
  misc_feature (22)..(23): bicyclic nucleic acid (BNA)
  misc_feature (3)..(3): 5-methyl
  misc_feature (6)..(6): 5-methyl
  misc_feature (18)..(18): 5-methyl
  misc_feature (23)..(23): 5-methyl
aacatcaaggaagatggcatttc

SEQ ID NO: 10567 - DNA, 22 bp, Artificial Sequence
  Description of Artificial Sequence: Synthetic Antisense oligonucleotide
  misc_feature (1)..(2): bicyclic nucleic acid (BNA)
  misc_feature (21)..(22): bicyclic nucleic acid (BNA)
  misc_feature (3)..(3): 5-methyl
  misc_feature (6)..(6): 5-methyl
  misc_feature (18)..(18): 5-methyl
aacatcaaggaagatggcattt

SEQ ID NO: 10568 - DNA, 21 bp, Artificial Sequence
  Description of Artificial Sequence: Synthetic Antisense oligonucleotide
  misc_feature (1)..(2): bicyclic nucleic acid (BNA)
  misc_feature (20)..(21): bicyclic nucleic acid (BNA)
  misc_feature (3)..(3): 5-methyl
  misc_feature (6)..(6): 5-methyl
  misc_feature (18)..(18): 5-methyl
aacatcaaggaagatggcatt

SEQ ID NO: 10569 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (3)..(3): 5-methyl
  misc_feature (6)..(6): 5-methyl
  misc_feature (18)..(18): 5-methyl
aacatcaaggaagatggcat

SEQ ID NO: 10570 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (3)..(3): 5-methyl
  misc_feature (6)..(6): 5-methyl
  misc_feature (18)..(18): 5-methyl
aacatcaaggaagatggca

SEQ ID NO: 10571 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (3)..(3): 5-methyl
  misc_feature (6)..(6): 5-methyl
  misc_feature (18)..(18): 5-methyl
aacatcaaggaagatggc

SEQ ID NO: 10572 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (3)..(3): 5-methyl
  misc_feature (6)..(6): 5-methyl
aacatcaaggaagatgg

SEQ ID NO: 10573 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (3)..(3): 5-methyl
  misc_feature (6)..(6): 5-methyl
aacatcaaggaagatg

SEQ ID NO: 10574 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (3)..(3): 5-methyl
  misc_feature (6)..(6): 5-methyl
aacatcaaggaagat

SEQ ID NO: 10575 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (3)..(3): 5-methyl
  misc_feature (6)..(6): 5-methyl
aacatcaaggaaga

SEQ ID NO: 10576 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (3)..(3): 5-methyl
  misc_feature (6)..(6): 5-methyl
aacatcaaggaag

SEQ ID NO: 10577 - DNA, 25 bp, Artificial Sequence
  Description of Artificial Sequence: Synthetic Antisense oligonucleotide
  misc_feature (1)..(2): bicyclic nucleic acid (BNA)
  misc_feature (24)..(25): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttctag

SEQ ID NO: 10578 - DNA, 24 bp, Artificial Sequence
  Description of Artificial Sequence: Synthetic Antisense oligonucleotide
  misc_feature (1)..(2): bicyclic nucleic acid (BNA)
  misc_feature (23)..(24): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttcta

SEQ ID NO: 10579 - DNA, 23 bp, Artificial Sequence
  Description of Artificial Sequence: Synthetic Antisense oligonucleotide
  misc_feature (1)..(2): bicyclic nucleic acid (BNA)
  misc_feature (22)..(23): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttct

SEQ ID NO: 10580 - DNA, 22 bp, Artificial Sequence
  Description of Artificial Sequence: Synthetic Antisense oligonucleotide
  misc_feature (1)..(2): bicyclic nucleic acid (BNA)
  misc_feature (21)..(22): bicyclic nucleic acid (BNA)
  misc_feature (2)..(2): 5-methyl
  misc_feature (5)..(5): 5-methyl
  misc_feature (17)..(17): 5-methyl
  misc_feature (22)..(22): 5-methyl
acatcaaggaagatggcatttc

SEQ ID NO: 10581 - DNA, 21 bp, Artificial Sequence
  Description of Artificial Sequence: Synthetic Antisense oligonucleotide
  misc_feature (1)..(2): bicyclic nucleic acid (BNA)
  misc_feature (20)..(21): bicyclic nucleic acid (BNA)
  misc_feature (2)..(2): 5-methyl
  misc_feature (5)..(5): 5-methyl
  misc_feature (17)..(17): 5-methyl
acatcaaggaagatggcattt

SEQ ID NO: 10582 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (2)..(2): 5-methyl
  misc_feature (5)..(5): 5-methyl
  misc_feature (17)..(17): 5-methyl
acatcaaggaagatggcatt

SEQ ID NO: 10583 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (2)..(2): 5-methyl
  misc_feature (5)..(5): 5-methyl
  misc_feature (17)..(17): 5-methyl
acatcaaggaagatggcat

SEQ ID NO: 10584 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (2)..(2): 5-methyl
  misc_feature (5)..(5): 5-methyl
  misc_feature (17)..(17): 5-methyl
acatcaaggaagatggca

SEQ ID NO: 10585 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (2)..(2): 5-methyl
  misc_feature (5)..(5): 5-methyl
  misc_feature (17)..(17): 5-methyl
acatcaaggaagatggc

SEQ ID NO: 10586 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (2)..(2): 5-methyl
  misc_feature (5)..(5): 5-methyl
acatcaaggaagatgg

SEQ ID NO: 10587 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (2)..(2): 5-methyl
  misc_feature (5)..(5): 5-methyl
acatcaaggaagatg

SEQ ID NO: 10588 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (2)..(2): 5-methyl
  misc_feature (5)..(5): 5-methyl
acatcaaggaagat

SEQ ID NO: 10589 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (2)..(2): 5-methyl
  misc_feature (5)..(5): 5-methyl
acatcaaggaaga

SEQ ID NO: 10590 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (2)..(2): 5-methyl
  misc_feature (5)..(5): 5-methyl
acatcaaggaag

SEQ ID NO: 10591 - DNA, 24 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(2): bicyclic nucleic acid (BNA)
  misc_feature (23)..(24): bicyclic nucleic acid (BNA)
catcaaggaagatggcatttctag

SEQ ID NO: 10592 - DNA, 23 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(2): bicyclic nucleic acid (BNA)
  misc_feature (22)..(23): bicyclic nucleic acid (BNA)
catcaaggaagatggcatttcta

SEQ ID NO: 10593 - DNA, 22 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(2): bicyclic nucleic acid (BNA)
  misc_feature (21)..(22): bicyclic nucleic acid (BNA)
catcaaggaagatggcatttct

SEQ ID NO: 10594 - DNA, 21 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (21)..(21): 5-methyl
  misc_feature (1)..(2): bicyclic nucleic acid (BNA)
  misc_feature (20)..(21): bicyclic nucleic acid (BNA)
catcaaggaagatggcatttc

SEQ ID NO: 10595 - DNA, 20 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
  misc_feature (19)..(20): bicyclic nucleic acid (BNA)
catcaaggaagatggcattt

SEQ ID NO: 10596 - DNA, 19 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
  misc_feature (18)..(19): bicyclic nucleic acid (BNA)
catcaaggaagatggcatt

SEQ ID NO: 10597 - DNA, 18 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
  misc_feature (17)..(18): bicyclic nucleic acid (BNA)
catcaaggaagatggcat

SEQ ID NO: 10598 - DNA, 17 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
  misc_feature (16)..(17): bicyclic nucleic acid (BNA)
catcaaggaagatggca

SEQ ID NO: 10599 - DNA, 16 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (16)..(16): 5-methyl
  misc_feature (1)..(2): bicyclic nucleic acid (BNA)
  misc_feature (15)..(16): bicyclic nucleic acid (BNA)
catcaaggaagatggc

SEQ ID NO: 10600 - DNA, 15 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
  misc_feature (14)..(15): bicyclic nucleic acid (BNA)
catcaaggaagatgg

SEQ ID NO: 10601 - DNA, 14 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
  misc_feature (13)..(14): bicyclic nucleic acid (BNA)
catcaaggaagatg

SEQ ID NO: 10602 - DNA, 13 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
  misc_feature (12)..(13): bicyclic nucleic acid (BNA)
catcaaggaagat

SEQ ID NO: 10603 - DNA, 12 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
  misc_feature (11)..(12): bicyclic nucleic acid (BNA)
catcaaggaaga

SEQ ID NO: 10604 - DNA, 11 bp, Artificial Sequence
  Description of Artificial Sequence: Synthetic Antisense oligonucleotide
  misc_feature (1)..(1): 5-methyl
  misc_feature (4)..(4): 5-methyl
  misc_feature (1)..(2): bicyclic nucleic acid (BNA)
  misc_feature (10)..(11): bicyclic nucleic acid (BNA)
catcaaggaag

SEQ ID NO: 10605 - DNA, 23 bp, Artificial Sequence
  Description of Artificial Sequence: Synthetic Antisense oligonucleotide
  misc_feature (1)..(2): bicyclic nucleic acid (BNA)
  misc_feature (22)..(23): bicyclic nucleic acid (BNA)
  misc_feature (3)..(3): 5-methyl
  misc_feature (15)..(15): 5-methyl
  misc_feature (20)..(20): 5-methyl
atcaaggaagatggcatttctag

SEQ ID NO: 10606 - DNA, 22 bp, Artificial Sequence
  Description of Artificial Sequence: Synthetic Antisense oligonucleotide
  misc_feature (1)..(2): bicyclic nucleic acid (BNA)
  misc_feature (21)..(22): bicyclic nucleic acid (BNA)
  misc_feature (3)..(3): 5-methyl
  misc_feature (15)..(15): 5-methyl
  misc_feature (20)..(20): 5-methyl
atcaaggaagatggcatttcta

SEQ ID NO: 10607 - DNA, 21 bp, Artificial Sequence
  Description of Artificial Sequence: Synthetic Antisense oligonucleotide
  misc_feature (1)..(2): bicyclic nucleic acid (BNA)
  misc_feature (20)..(21): bicyclic nucleic acid (BNA)
  misc_feature (3)..(3): 5-methyl
  misc_feature (15)..(15): 5-methyl
  misc_feature (20)..(20): 5-methyl
atcaaggaagatggcatttct

SEQ ID NO: 10608 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (3)..(3): 5-methyl
  misc_feature (15)..(15): 5-methyl
  misc_feature (20)..(20): 5-methyl
atcaaggaagatggcatttc

SEQ ID NO: 10609 - DNA, 19 bp, Artificial Sequence
  Description of Artificial Sequence: Synthetic Antisense oligonucleotide
  misc_feature (1)..(2): bicyclic nucleic acid (BNA)
  misc_feature (18)..(19): bicyclic nucleic acid (BNA)
  misc_feature (3)..(3): 5-methyl
  misc_feature (15)..(15): 5-methyl
atcaaggaagatggcattt

SEQ ID NO: 10610 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (3)..(3): 5-methyl
  misc_feature (15)..(15): 5-methyl
atcaaggaagatggcatt

SEQ ID NO: 10611 - DNA, 17 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (3)..(3): 5-methyl
  misc_feature (15)..(15): 5-methyl
atcaaggaagatggcat

SEQ ID NO: 10612 - DNA, 16 bp, Artificial Sequence
  Description of Artificial Sequence: Synthetic Antisense oligonucleotide
  misc_feature (1)..(2): bicyclic nucleic acid (BNA)
  misc_feature (15)..(16): bicyclic nucleic acid (BNA)
  misc_feature (3)..(3): 5-methyl
  misc_feature (15)..(15): 5-methyl
atcaaggaagatggca

SEQ ID NO: 10613 - DNA, 15 bp, Artificial Sequence
  Description of Artificial Sequence: Synthetic Antisense oligonucleotide
  misc_feature (1)..(2): bicyclic nucleic acid (BNA)
  misc_feature (14)..(15): bicyclic nucleic acid (BNA)
  misc_feature (3)..(3): 5-methyl
  misc_feature (15)..(15): 5-methyl
atcaaggaagatggc

SEQ ID NO: 10614 - DNA, 14 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (3)..(3): 5-methyl
atcaaggaagatgg

SEQ ID NO: 10615 - DNA, 13 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (3)..(3): 5-methyl
atcaaggaagatg

SEQ ID NO: 10616 - DNA, 12 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (3)..(3): 5-methyl
atcaaggaagat

SEQ ID NO: 10617 - DNA, 11 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (3)..(3): 5-methyl
atcaaggaaga

SEQ ID NO: 10618 - DNA, 10 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (3)..(3): 5-methyl
atcaaggaag

SEQ ID NO: 10619 - RNA, 18 nt, Artificial Sequence
  Description of Artificial Sequence: Synthetic Antisense oligonucleotide
  misc_feature (2)..(2): bicyclic nucleic acid (BNA)
gguaaguucuguccaagc

SEQ ID NO: 10620 - RNA, 18 nt, Artificial Sequence
  Description of Artificial Sequence: Synthetic Antisense oligonucleotide
  misc_feature (9)..(9): bicyclic nucleic acid (BNA)
gguaaguucuguccaagc

SEQ ID NO: 10621 - RNA, 18 nt, Artificial Sequence
  Description of Artificial Sequence: Synthetic Antisense oligonucleotide
  misc_feature (11)..(11): bicyclic nucleic acid (BNA)
gguaaguucuguccaagc

SEQ ID NO: 10622 - RNA, 18 nt, Artificial Sequence
  Description of Artificial Sequence: Synthetic Antisense oligonucleotide
  misc_feature (6)..(6): bicyclic nucleic acid (BNA)
gguaaguucuguccaagc

SEQ ID NO: 10623 - RNA, 18 nt, Artificial Sequence
  Description of Artificial Sequence: Synthetic Antisense oligonucleotide
  misc_feature (17)..(17): bicyclic nucleic acid (BNA)
gguaaguucuguccaagc

SEQ ID NO: 10624 - RNA, 18 nt, Artificial Sequence
  Description of Artificial Sequence: Synthetic Antisense oligonucleotide
  misc_feature (13)..(13): bicyclic nucleic acid (BNA)
gguaaguucuguccaagc

SEQ ID NO: 10625 - RNA, 18 nt, Artificial Sequence
  Description of Artificial Sequence: Synthetic Antisense oligonucleotide
  misc_feature (14)..(14): bicyclic nucleic acid (BNA)
gguaaguucuguccaagc

SEQ ID NO: 10626 - RNA, 18 nt, Artificial Sequence
  Description of Artificial Sequence: Synthetic Antisense oligonucleotide
  misc_feature (16)..(16): bicyclic nucleic acid (BNA)
guaaguucuguccaagcc

SEQ ID NO: 10627 - RNA, 18 nt, Artificial Sequence
  Description of Artificial Sequence: Synthetic Antisense oligonucleotide
  misc_feature (10)..(10): bicyclic nucleic acid (BNA)
guaaguucuguccaagcc

SEQ ID NO: 10628 - RNA, 18 nt, Artificial Sequence
  Description of Artificial Sequence: Synthetic Antisense oligonucleotide
  misc_feature (5)..(5): bicyclic nucleic acid (BNA)
guaaguucuguccaagcc

SEQ ID NO: 10629 - RNA, 18 nt, Artificial Sequence
  Description of Artificial Sequence: Synthetic Antisense oligonucleotide
  misc_feature (17)..(17): bicyclic nucleic acid (BNA)
guaaguucuguccaagcc

SEQ ID NO: 10630 - RNA, 18 nt, Artificial Sequence
  Description of Artificial Sequence: Synthetic Antisense oligonucleotide
  misc_feature (12)..(12): bicyclic nucleic acid (BNA)
guaaguucuguccaagcc

SEQ ID NO: 10631 - RNA, 18 nt, Artificial Sequence
  Description of Artificial Sequence: Synthetic Antisense oligonucleotide
  misc_feature (13)..(13): bicyclic nucleic acid (BNA)
guaaguucuguccaagcc

SEQ ID NO: 10632 - RNA, 18 nt, Artificial Sequence
  Description of Artificial Sequence: Synthetic Antisense oligonucleotide
  misc_feature (8)..(8): bicyclic nucleic acid (BNA)
guaaguucuguccaagcc

SEQ ID NO: 10633 - RNA, 18 nt, Artificial Sequence
  Description of Artificial Sequence: Synthetic Antisense oligonucleotide
  misc_feature (2)..(2): bicyclic nucleic acid (BNA)
agucgguaaguucugucc

SEQ ID NO: 10634 - RNA, 18 nt, Artificial Sequence
  Description of Artificial Sequence: Synthetic Antisense oligonucleotide
  misc_feature (4)..(4): bicyclic nucleic acid (BNA)
agucgguaaguucugucc

SEQ ID NO: 10635 - RNA, 18 nt, Artificial Sequence
  Description of Artificial Sequence: Synthetic Antisense oligonucleotide
  misc_feature (10)..(10): bicyclic nucleic acid (BNA)
agucgguaaguucugucc

SEQ ID NO: 10636 - RNA, 18 nt, Artificial Sequence
  Description of Artificial Sequence: Synthetic Antisense oligonucleotide
  misc_feature (5)..(5): bicyclic nucleic acid (BNA)
agucgguaaguucugucc

SEQ ID NO: 10637 - RNA, 18 nt, Artificial Sequence
  Description of Artificial Sequence: Synthetic Antisense oligonucleotide
  misc_feature (6)..(6): bicyclic nucleic acid (BNA)
agucgguaaguucugucc

SEQ ID NO: 10638 - RNA, 18 nt, Artificial Sequence
  Description of Artificial Sequence: Synthetic Antisense oligonucleotide
  misc_feature (17)..(17): bicyclic nucleic acid (BNA)
agucgguaaguucugucc

SEQ ID NO: 10639 - RNA, 18 nt, Artificial Sequence
  Description of Artificial Sequence: Synthetic Antisense oligonucleotide
  misc_feature (13)..(13): bicyclic nucleic acid (BNA)
agucgguaaguucugucc

SEQ ID NO: 10640 - RNA, 18 nt, Artificial Sequence
  Description of Artificial Sequence: Synthetic Antisense oligonucleotide
  misc_feature (15)..(15): bicyclic nucleic acid (BNA)
agucgguaaguucugucc

SEQ ID NO: 10641 - RNA, 18 nt, Artificial Sequence
  Description of Artificial Sequence: Synthetic Antisense oligonucleotide
  misc_feature (3)..(3): bicyclic nucleic acid (BNA)
cuguccaagcccgguuga

SEQ ID NO: 10642 - RNA, 18 nt, Artificial Sequence
  Description of Artificial Sequence: Synthetic Antisense oligonucleotide
  misc_feature (9)..(9): bicyclic nucleic acid (BNA)
cuguccaagcccgguuga

SEQ ID NO: 10643 - RNA, 18 nt, Artificial Sequence
  Description of Artificial Sequence: Synthetic Antisense oligonucleotide
  misc_feature (10)..(10): bicyclic nucleic acid (BNA)
cuguccaagcccgguuga

SEQ ID NO: 10644 - RNA, 18 nt, Artificial Sequence
  Description of Artificial Sequence: Synthetic Antisense oligonucleotide
  misc_feature (5)..(5): bicyclic nucleic acid (BNA)
cuguccaagcccgguuga

SEQ ID NO: 10645 - RNA, 18 nt, Artificial Sequence
  Description of Artificial Sequence: Synthetic Antisense oligonucleotide
  misc_feature (11)..(11): bicyclic nucleic acid (BNA)
cuguccaagcccgguuga

SEQ ID NO: 10646 - RNA, 18 nt, Artificial Sequence
  Description of Artificial Sequence: Synthetic Antisense oligonucleotide
  misc_feature (6)..(6): bicyclic nucleic acid (BNA)
cuguccaagcccgguuga

SEQ ID NO: 10647 - RNA, 18 nt, Artificial Sequence
  Description of Artificial Sequence: Synthetic Antisense oligonucleotide
  misc_feature (17)..(17): bicyclic nucleic acid (BNA)
cuguccaagcccgguuga

SEQ ID NO: 10648 - RNA, 18 nt, Artificial Sequence
  Description of Artificial Sequence: Synthetic Antisense oligonucleotide
  misc_feature (12)..(12): bicyclic nucleic acid (BNA)
cuguccaagcccgguuga

SEQ ID NO: 10649 - RNA, 18 nt, Artificial Sequence
  Description of Artificial Sequence: Synthetic Antisense oligonucleotide
  misc_feature (13)..(13): bicyclic nucleic acid (BNA)
cuguccaagcccgguuga

SEQ ID NO: 10650 - RNA, 18 nt, Artificial Sequence
  Description of Artificial Sequence: Synthetic Antisense oligonucleotide
  misc_feature (14)..(14): bicyclic nucleic acid (BNA)
cuguccaagcccgguuga

SEQ ID NO: 10651 - RNA, 18 nt, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
gguaaguucuguccaagc

SEQ ID NO: 10652 - RNA, 18 nt, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
gguaaguucuguccaagc

SEQ ID NO: 10653 - RNA, 18 nt, Artificial Sequence
  Description of Artificial Sequence: Synthetic Antisense oligonucleotide
  misc_feature (13)..(13): bicyclic nucleic acid (BNA)
  misc_feature (17)..(17): bicyclic nucleic acid (BNA)
gguaaguucuguccaagc

SEQ ID NO: 10654 - RNA, 18 nt, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
gguaaguucuguccaagc

SEQ ID NO: 10655 - RNA, 18 nt, Artificial Sequence
  Description of Artificial Sequence: Synthetic Antisense oligonucleotide
  misc_feature (13)..(14): bicyclic nucleic acid (BNA)
gguaaguucuguccaagc

SEQ ID NO: 10656 - RNA, 18 nt, Artificial Sequence
  Description of Artificial Sequence: Synthetic Antisense oligonucleotide
  misc_feature (2)..(2): bicyclic nucleic acid (BNA)
  misc_feature (17)..(17): bicyclic nucleic acid (BNA)
gguaaguucuguccaagc

SEQ ID NO: 10657 - RNA, 18 nt, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
gguaaguucuguccaagc

SEQ ID NO: 10658 - RNA, 18 nt, Artificial Sequence
  Description of Artificial Sequence: Synthetic Antisense oligonucleotide
  misc_feature (9)..(9): bicyclic nucleic acid (BNA)
  misc_feature (11)..(11): bicyclic nucleic acid (BNA)
gguaaguucuguccaagc

SEQ ID NO: 10659 - RNA, 18 nt, Artificial Sequence
  Description of Artificial Sequence: Synthetic Antisense oligonucleotide
  misc_feature (14)..(14): bicyclic nucleic acid (BNA)
  misc_feature (17)..(17): bicyclic nucleic acid (BNA)
gguaaguucuguccaagc

SEQ ID NO: 10660 - RNA, 18 nt, Artificial Sequence
  Description of Artificial Sequence: Synthetic Antisense oligonucleotide
  misc_feature (11)..(11): bicyclic nucleic acid (BNA)
  misc_feature (13)..(13): bicyclic nucleic acid (BNA)
gguaaguucuguccaagc

SEQ ID NO: 10661 - RNA, 18 nt, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
gguaaguucuguccaagc

SEQ ID NO: 10662 - RNA, 18 nt, Artificial Sequence
  Description of Artificial Sequence: Synthetic Antisense oligonucleotide
  misc_feature (2)..(2): bicyclic nucleic acid (BNA)
  misc_feature (11)..(11): bicyclic nucleic acid (BNA)
gguaaguucuguccaagc

SEQ ID NO: 10663 - RNA, 18 nt, Artificial Sequence
  Description of Artificial Sequence: Synthetic Antisense oligonucleotide
  misc_feature (9)..(9): bicyclic nucleic acid (BNA)
  misc_feature (17)..(17): bicyclic nucleic acid (BNA)
gguaaguucuguccaagc

SEQ ID NO: 10664 - RNA, 18 nt, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
gguaaguucuguccaagc

SEQ ID NO: 10665 - RNA, 18 nt, Artificial Sequence
  Description of Artificial Sequence: Synthetic Antisense oligonucleotide
  misc_feature (11)..(11): bicyclic nucleic acid (BNA)
  misc_feature (14)..(14): bicyclic nucleic acid (BNA)
gguaaguucuguccaagc

SEQ ID NO: 10666 - RNA, 18 nt, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
gguaaguucuguccaagc

SEQ ID NO: 10667 - RNA, 18 nt, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
gguaaguucuguccaagc

SEQ ID NO: 10668 - RNA, 18 nt, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
gguaaguucuguccaagc

SEQ ID NO: 10669 - RNA, 18 nt, Artificial Sequence
  Description of Artificial Sequence: Synthetic Antisense oligonucleotide
  misc_feature (6)..(6): bicyclic nucleic acid (BNA)
  misc_feature (17)..(17): bicyclic nucleic acid (BNA)
gguaaguucuguccaagc

SEQ ID NO: 10670 - RNA, 18 nt, Artificial Sequence
  Description of Artificial Sequence: Synthetic Antisense oligonucleotide
  misc_feature (11)..(11): bicyclic nucleic acid (BNA)
  misc_feature (17)..(17): bicyclic nucleic acid (BNA)
gguaaguucuguccaagc

SEQ ID NO: 10671 - RNA, 18 nt, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
gguaaguucuguccaagc

SEQ ID NO: 10672 - RNA, 18 nt, Artificial Sequence
  Description of Artificial Sequence: Synthetic Antisense oligonucleotide
  misc_feature (12)..(12): bicyclic nucleic acid (BNA)
  misc_feature (17)..(17): bicyclic nucleic acid (BNA)
guaaguucuguccaagcc

SEQ ID NO: 10673 - RNA, 18 nt, Artificial Sequence
  Description of Artificial Sequence: Synthetic Antisense oligonucleotide
  misc_feature (5)..(5): bicyclic nucleic acid (BNA)
  misc_feature (8)..(8): bicyclic nucleic acid (BNA)
guaaguucuguccaagcc

SEQ ID NO: 10674 - RNA, 18 nt, Artificial Sequence
  Description of Artificial Sequence: Synthetic Antisense oligonucleotide
  misc_feature (8)..(8): bicyclic nucleic acid (BNA)
  misc_feature (13)..(13): bicyclic nucleic acid (BNA)
guaaguucuguccaagcc

SEQ ID NO: 10675 - RNA, 18 nt, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
guaaguucuguccaagcc

SEQ ID NO: 10676 - RNA, 18 nt, Artificial Sequence
  Description of Artificial Sequence: Synthetic Antisense oligonucleotide
  misc_feature (8)..(8): bicyclic nucleic acid (BNA)
  misc_feature (17)..(17): bicyclic nucleic acid (BNA)
guaaguucuguccaagcc

SEQ ID NO: 10677 - RNA, 18 nt, Artificial Sequence
  Description of Artificial Sequence: Synthetic Antisense oligonucleotide
  misc_feature (13)..(13): bicyclic nucleic acid (BNA)
  misc_feature (17)..(17): bicyclic nucleic acid (BNA)
guaaguucuguccaagcc

SEQ ID NO: 10678 - RNA, 18 nt, Artificial Sequence
  Description of Artificial Sequence: Synthetic Antisense oligonucleotide
  misc_feature (8)..(8): bicyclic nucleic acid (BNA)
  misc_feature (12)..(12): bicyclic nucleic acid (BNA)
guaaguucuguccaagcc

SEQ ID NO: 10679 - RNA, 18 nt, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
guaaguucuguccaagcc

SEQ ID NO: 10680 - RNA, 18 nt, Artificial Sequence
  Description of Artificial Sequence: Synthetic Antisense oligonucleotide
  misc_feature (8)..(8): bicyclic nucleic acid (BNA)
  misc_feature (16)..(16): bicyclic nucleic acid (BNA)
guaaguucuguccaagcc

SEQ ID NO: 10681 - RNA, 18 nt, Artificial Sequence
  Description of Artificial Sequence: Synthetic Antisense oligonucleotide
  misc_feature (10)..(10): bicyclic nucleic acid (BNA)
  misc_feature (16)..(16): bicyclic nucleic acid (BNA)
guaaguucuguccaagcc

SEQ ID NO: 10682 - RNA, 18 nt, Artificial Sequence
  Description of Artificial Sequence: Synthetic Antisense oligonucleotide
  misc_feature (10)..(10): bicyclic nucleic acid (BNA)
  misc_feature (12)..(12): bicyclic nucleic acid (BNA)
guaaguucuguccaagcc

SEQ ID NO: 10683 - RNA, 18 nt, Artificial Sequence
  Description of Artificial Sequence: Synthetic Antisense oligonucleotide
  misc_feature (5)..(5): bicyclic nucleic acid (BNA)
  misc_feature (17)..(17): bicyclic nucleic acid (BNA)
guaaguucuguccaagcc

SEQ ID NO: 10684 - RNA, 18 nt, Artificial Sequence
  Description of Artificial Sequence: Synthetic Antisense oligonucleotide
  misc_feature (10)..(10): bicyclic nucleic acid (BNA)
  misc_feature (17)..(17): bicyclic nucleic acid (BNA)
guaaguucuguccaagcc

SEQ ID NO: 10685 - RNA, 18 nt, Artificial Sequence
  Description of Artificial Sequence: Synthetic Antisense oligonucleotide
  misc_feature (12)..(13): bicyclic nucleic acid (BNA)
guaaguucuguccaagcc

SEQ ID NO: 10686 - RNA, 18 nt, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
guaaguucuguccaagcc

SEQ ID NO: 10687 - RNA, 18 nt, Artificial Sequence
  Description of Artificial Sequence: Synthetic Antisense oligonucleotide
  misc_feature (8)..(8): bicyclic nucleic acid (BNA)
  misc_feature (10)..(10): bicyclic nucleic acid (BNA)
guaaguucuguccaagcc

SEQ ID NO: 10688 - RNA, 18 nt, Artificial Sequence
  Description of Artificial Sequence: Synthetic Antisense oligonucleotide
  misc_feature (13)..(13): bicyclic nucleic acid (BNA)
  misc_feature (16)..(16): bicyclic nucleic acid (BNA)
guaaguucuguccaagcc

SEQ ID NO: 10689 - RNA, 18 nt, Artificial Sequence
  Description of Artificial Sequence: Synthetic Antisense oligonucleotide
  misc_feature (5)..(5): bicyclic nucleic acid (BNA)
  misc_feature (16)..(16): bicyclic nucleic acid (BNA)
guaaguucuguccaagcc

SEQ ID NO: 10690 - RNA, 18 nt, Artificial Sequence
  Description of Artificial Sequence: Synthetic Antisense oligonucleotide
  misc_feature (12)..(12): bicyclic nucleic acid (BNA)
  misc_feature (16)..(16): bicyclic nucleic acid (BNA)
guaaguucuguccaagcc

SEQ ID NO: 10691 - RNA, 18 nt, Artificial Sequence
  Description of Artificial Sequence: Synthetic Antisense oligonucleotide
  misc_feature (16)..(17): bicyclic nucleic acid (BNA)
guaaguucuguccaagcc

SEQ ID NO: 10692 - RNA, 18 nt, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
guaaguucuguccaagcc

SEQ ID NO: 10693 - RNA, 18 nt, Artificial Sequence
  Description of Artificial Sequence: Synthetic Antisense oligonucleotide
  misc_feature (6)..(6): bicyclic nucleic acid (BNA)
  misc_feature (10)..(10): bicyclic nucleic acid (BNA)
agucgguaaguucugucc

SEQ ID NO: 10694 - RNA, 18 nt, Artificial Sequence
  Description of Artificial Sequence: Synthetic Antisense oligonucleotide
  misc_feature (2)..(2): bicyclic nucleic acid (BNA)
  misc_feature (4)..(4): bicyclic nucleic acid (BNA)
agucgguaaguucugucc

SEQ ID NO: 10695 - RNA, 18 nt, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
agucgguaaguucugucc

SEQ ID NO: 10696 - RNA, 18 nt, Artificial Sequence
  Description of Artificial Sequence: Synthetic Antisense oligonucleotide
  misc_feature (13)..(13): bicyclic nucleic acid (BNA)
  misc_feature (17)..(17): bicyclic nucleic acid (BNA)
agucgguaaguucugucc

SEQ ID NO: 10697 - RNA, 18 nt, Artificial Sequence
  Description of Artificial Sequence: Synthetic Antisense oligonucleotide
  misc_feature (4)..(4): bicyclic nucleic acid (BNA)
  misc_feature (15)..(15): bicyclic nucleic acid (BNA)
agucgguaaguucugucc

SEQ ID NO: 10698 - RNA, 18 nt, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
agucgguaaguucugucc

SEQ ID NO: 10699 - RNA, 18 nt, Artificial Sequence
  Description of Artificial Sequence: Synthetic Antisense oligonucleotide
  misc_feature (2)..(2): bicyclic nucleic acid (BNA)
  misc_feature (17)..(17): bicyclic nucleic acid (BNA)
agucgguaaguucugucc

SEQ ID NO: 10700 - RNA, 18 nt, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
agucgguaaguucugucc

SEQ ID NO: 10701 - RNA, 18 nt, Artificial Sequence
  Description of Artificial Sequence: Synthetic Antisense oligonucleotide
  misc_feature (2)..(2): bicyclic nucleic acid (BNA)
  misc_feature (15)..(15): bicyclic nucleic acid (BNA)
agucgguaaguucugucc

SEQ ID NO: 10702 - RNA, 18 nt, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
agucgguaaguucugucc

SEQ ID NO: 10703 - RNA, 18 nt, Artificial Sequence
  Description of Artificial Sequence: Synthetic Antisense oligonucleotide
  misc_feature (4)..(4): bicyclic nucleic acid (BNA)
  misc_feature (17)..(17): bicyclic nucleic acid (BNA)
agucgguaaguucugucc

SEQ ID NO: 10704 - RNA, 18 nt, Artificial Sequence
  Description of Artificial Sequence: Synthetic Antisense oligonucleotide
  misc_feature (10)..(10): bicyclic nucleic acid (BNA)
  misc_feature (15)..(15): bicyclic nucleic acid (BNA)
agucgguaaguucugucc

SEQ ID NO: 10705 - RNA, 18 nt, Artificial Sequence
  Description of Artificial Sequence: Synthetic Antisense oligonucleotide
  misc_feature (13)..(13): bicyclic nucleic acid (BNA)
  misc_feature (15)..(15): bicyclic nucleic acid (BNA)
agucgguaaguucugucc

SEQ ID NO: 10706 - RNA, 18 nt, Artificial Sequence
  Description of Artificial Sequence: Synthetic Antisense oligonucleotide
  misc_feature (5)..(6): bicyclic nucleic acid (BNA)
agucgguaaguucugucc

SEQ ID NO: 10707 - RNA, 18 nt, Artificial Sequence
  Description of Artificial Sequence: Synthetic Antisense oligonucleotide
  misc_feature (5)..(5): bicyclic nucleic acid (BNA)
  misc_feature (15)..(15): bicyclic nucleic acid (BNA)
agucgguaaguucugucc

SEQ ID NO: 10708 - RNA, 18 nt, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
agucgguaaguucugucc

SEQ ID NO: 10709 - RNA, 18 nt, Artificial Sequence
  Description of Artificial Sequence: Synthetic Antisense oligonucleotide
  misc_feature (5)..(5): bicyclic nucleic acid (BNA)
  misc_feature (17)..(17): bicyclic nucleic acid (BNA)
agucgguaaguucugucc

SEQ ID NO: 10710 - RNA, 18 nt, Artificial Sequence
  Description of Artificial Sequence: Synthetic Antisense oligonucleotide
  misc_feature (10)..(10): bicyclic nucleic acid (BNA)
  misc_feature (17)..(17): bicyclic nucleic acid (BNA)
agucgguaaguucugucc

SEQ ID NO: 10711 - RNA, 18 nt, Artificial Sequence
  Description of Artificial Sequence: Synthetic Antisense oligonucleotide
  misc_feature (4)..(4): bicyclic nucleic acid (BNA)
  misc_feature (10)..(10): bicyclic nucleic acid (BNA)
agucgguaaguucugucc

SEQ ID NO: 10712 - RNA, 18 nt, Artificial Sequence
  Description of Artificial Sequence: Synthetic Antisense oligonucleotide
  misc_feature (2)..(2): bicyclic nucleic acid (BNA)
  misc_feature (10)..(10): bicyclic nucleic acid (BNA)
agucgguaaguucugucc

SEQ ID NO: 10713 - RNA, 18 nt, Artificial Sequence
  Description of Artificial Sequence: Synthetic Antisense oligonucleotide
  misc_feature (4)..(4): bicyclic nucleic acid (BNA)
  misc_feature (6)..(6): bicyclic nucleic acid (BNA)
agucgguaaguucugucc

SEQ ID NO: 10714 - RNA, 18 nt, Artificial Sequence
  Description of Artificial Sequence: Synthetic Antisense oligonucleotide
  misc_feature (4)..(4): bicyclic nucleic acid (BNA)
  misc_feature (13)..(13): bicyclic nucleic acid (BNA)
agucgguaaguucugucc

SEQ ID NO: 10715 - RNA, 18 nt, Artificial Sequence
  Description of Artificial Sequence: Synthetic Antisense oligonucleotide
  misc_feature (15)..(15): bicyclic nucleic acid (BNA)
  misc_feature (17)..(17): bicyclic nucleic acid (BNA)
agucgguaaguucugucc

SEQ ID NO: 10716 - RNA, 18 nt, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
agucgguaaguucugucc

SEQ ID NO: 10717 - RNA, 18 nt, Artificial Sequence
  Description of Artificial Sequence: Synthetic Antisense oligonucleotide
  misc_feature (6)..(6): bicyclic nucleic acid (BNA)
  misc_feature (17)..(17): bicyclic nucleic acid (BNA)
agucgguaaguucugucc

SEQ ID NO: 10718 - RNA, 18 nt, Artificial Sequence
  Description of Artificial Sequence: Synthetic Antisense oligonucleotide
  misc_feature (6)..(6): bicyclic nucleic acid (BNA)
  misc_feature (15)..(15): bicyclic nucleic acid (BNA)
agucgguaaguucugucc

SEQ ID NO: 10719 - RNA, 18 nt, Artificial Sequence
  Description of Artificial Sequence: Synthetic Antisense oligonucleotide
  misc_feature (4)..(5): bicyclic nucleic acid (BNA)
agucgguaaguucugucc

SEQ ID NO: 10720 - RNA, 18 nt, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
agucgguaaguucugucc

SEQ ID NO: 10721 - RNA, 18 nt, Artificial Sequence
  Description of Artificial Sequence: Synthetic Antisense oligonucleotide
  misc_feature (12)..(12): bicyclic nucleic acid (BNA)
  misc_feature (17)..(17): bicyclic nucleic acid (BNA)
cuguccaagcccgguuga

SEQ ID NO: 10722 - RNA, 18 nt, Artificial Sequence
  Description of Artificial Sequence: Synthetic Antisense oligonucleotide
  misc_feature (6)..(6): bicyclic nucleic acid (BNA)
  misc_feature (10)..(10): bicyclic nucleic acid (BNA)
cuguccaagcccgguuga

SEQ ID NO: 10723 - RNA, 18 nt, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
cuguccaagcccgguuga

SEQ ID NO: 10724 - RNA, 18 nt, Artificial Sequence
  Description of Artificial Sequence: Synthetic Antisense oligonucleotide
  misc_feature (11)..(12): bicyclic nucleic acid (BNA)
cuguccaagcccgguuga

SEQ ID NO: 10725 - RNA, 18 nt, Artificial Sequence
  Description of Artificial Sequence: Synthetic Antisense oligonucleotide
  misc_feature (5)..(5): bicyclic nucleic acid (BNA)
  misc_feature (9)..(9): bicyclic nucleic acid (BNA)
cuguccaagcccgguuga

SEQ ID NO: 10726 - RNA, 18 nt, Artificial Sequence
  Description of Artificial Sequence: Synthetic Antisense oligonucleotide
  misc_feature (3)..(3): bicyclic nucleic acid (BNA)
  misc_feature (9)..(9): bicyclic nucleic acid (BNA)
cuguccaagcccgguuga

SEQ ID NO: 10727 - RNA, 18 nt, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
cuguccaagcccgguuga

SEQ ID NO: 10728 - RNA, 18 nt, Artificial Sequence
  Description of Artificial Sequence: Synthetic Antisense oligonucleotide
  misc_feature (9)..(10): bicyclic nucleic acid (BNA)
cuguccaagcccgguuga

SEQ ID NO: 10729 - RNA, 18 nt, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
cuguccaagcccgguuga

SEQ ID NO: 10730 - RNA, 18 nt, Artificial Sequence
  Description of Artificial Sequence: Synthetic Antisense oligonucleotide
  misc_feature (3)..(3): bicyclic nucleic acid (BNA)
  misc_feature (13)..(13): bicyclic nucleic acid (BNA)
cuguccaagcccgguuga

SEQ ID NO: 10731 - RNA, 18 nt, Artificial Sequence
  Description of Artificial Sequence: Synthetic Antisense oligonucleotide
  misc_feature (13)..(13): bicyclic nucleic acid (BNA)
  misc_feature (17)..(17): bicyclic nucleic acid (BNA)
cuguccaagcccgguuga

SEQ ID NO: 10732 - RNA, 18 nt, Artificial Sequence
  Description of Artificial Sequence: Synthetic Antisense oligonucleotide
  misc_feature (3)..(3): bicyclic nucleic acid (BNA)
  misc_feature (6)..(6): bicyclic nucleic acid (BNA)
cuguccaagcccgguuga

SEQ ID NO: 10733 - RNA, 18 nt, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
cuguccaagcccgguuga

SEQ ID NO: 10734 - RNA, 18 nt, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
cuguccaagcccgguuga

SEQ ID NO: 10735 - RNA, 18 nt, Artificial Sequence
  Description of Artificial Sequence: Synthetic Antisense oligonucleotide
  misc_feature (3)..(3): bicyclic nucleic acid (BNA)
  misc_feature (10)..(10): bicyclic nucleic acid (BNA)
cuguccaagcccgguuga

SEQ ID NO: 10736 - RNA, 18 nt, Artificial Sequence
  Description of Artificial Sequence: Synthetic Antisense oligonucleotide
  misc_feature (13)..(14): bicyclic nucleic acid (BNA)
cuguccaagcccgguuga

SEQ ID NO: 10737 - RNA, 18 nt, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
cuguccaagcccgguuga

SEQ ID NO: 10738 - RNA, 18 nt, Artificial Sequence
  Description of Artificial Sequence: Synthetic Antisense oligonucleotide
  misc_feature (9)..(9): bicyclic nucleic acid (BNA)
  misc_feature (11)..(11): bicyclic nucleic acid (BNA)
cuguccaagcccgguuga

SEQ ID NO: 10739 - RNA, 18 nt, Artificial Sequence
  Description of Artificial Sequence: Synthetic Antisense oligonucleotide
  misc_feature (14)..(14): bicyclic nucleic acid (BNA)
  misc_feature (17)..(17): bicyclic nucleic acid (BNA)
cuguccaagcccgguuga

SEQ ID NO: 10740 - RNA, 18 nt, Artificial Sequence
  Description of Artificial Sequence: Synthetic Antisense oligonucleotide
  misc_feature (11)..(11): bicyclic nucleic acid (BNA)
  misc_feature (13)..(13): bicyclic nucleic acid (BNA)
cuguccaagcccgguuga

SEQ ID NO: 10741 - RNA, 18 nt, Artificial Sequence
  Description of Artificial Sequence: Synthetic Antisense oligonucleotide
  misc_feature (5)..(5): bicyclic nucleic acid (BNA)
  misc_feature (14)..(14): bicyclic nucleic acid (BNA)
cuguccaagcccgguuga

SEQ ID NO: 10742 - RNA, 18 nt, Artificial Sequence
  Description of Artificial Sequence: Synthetic Antisense oligonucleotide
  misc_feature (3)..(3): bicyclic nucleic acid (BNA)
  misc_feature (14)..(14): bicyclic nucleic acid (BNA)
cuguccaagcccgguuga

SEQ ID NO: 10743 - RNA, 18 nt, Artificial Sequence
  Description of Artificial Sequence: Synthetic Antisense oligonucleotide
  misc_feature (10)..(10): bicyclic nucleic acid (BNA)
  misc_feature (12)..(12): bicyclic nucleic acid (BNA)
cuguccaagcccgguuga

SEQ ID NO: 10744 - RNA, 18 nt, Artificial Sequence
  Description of Artificial Sequence: Synthetic Antisense oligonucleotide
  misc_feature (9)..(9): bicyclic nucleic acid (BNA)
  misc_feature (17)..(17): bicyclic nucleic acid (BNA)
cuguccaagcccgguuga

SEQ ID NO: 10745 - RNA, 18 nt, Artificial Sequence
  Description of Artificial Sequence: Synthetic Antisense oligonucleotide
  misc_feature (12)..(12): bicyclic nucleic acid (BNA)
  misc_feature (14)..(14): bicyclic nucleic acid (BNA)
cuguccaagcccgguuga

SEQ ID NO: 10746 - RNA, 18 nt, Artificial Sequence
  Description of Artificial Sequence: Synthetic Antisense oligonucleotide
  misc_feature (5)..(5): bicyclic nucleic acid (BNA)
  misc_feature (11)..(11): bicyclic nucleic acid (BNA)
cuguccaagcccgguuga

SEQ ID NO: 10747 - RNA, 18 nt, Artificial Sequence
  Description of Artificial Sequence: Synthetic Antisense oligonucleotide
  misc_feature (3)..(3): bicyclic nucleic acid (BNA)
  misc_feature (17)..(17): bicyclic nucleic acid (BNA)
cuguccaagcccgguuga

SEQ ID NO: 10748 - RNA, 18 nt, Artificial Sequence
  Description of Artificial Sequence: Synthetic Antisense oligonucleotide
  misc_feature (6)..(6): bicyclic nucleic acid (BNA)
  misc_feature (12)..(12): bicyclic nucleic acid (BNA)
cuguccaagcccgguuga

SEQ ID NO: 10749 - RNA, 18 nt, Artificial Sequence
  Description of Artificial Sequence: Synthetic Antisense oligonucleotide
  misc_feature (5)..(6): bicyclic nucleic acid (BNA)
cuguccaagcccgguuga

SEQ ID NO: 10750 - RNA, 18 nt, Artificial Sequence
  Description of Artificial Sequence: Synthetic Antisense oligonucleotide
  misc_feature (11)..(11): bicyclic nucleic acid (BNA)
  misc_feature (14)..(14): bicyclic nucleic acid (BNA)
cuguccaagcccgguuga

SEQ ID NO: 10751 - RNA, 18 nt, Artificial Sequence
  Description of Artificial Sequence: Synthetic Antisense oligonucleotide
  misc_feature (9)..(9): bicyclic nucleic acid (BNA)
  misc_feature (12)..(12): bicyclic nucleic acid (BNA)
cuguccaagcccgguuga

SEQ ID NO: 10752 - RNA, 18 nt, Artificial Sequence
  Description of Artificial Sequence: Synthetic Antisense oligonucleotide
  misc_feature (5)..(5): bicyclic nucleic acid (BNA)
  misc_feature (17)..(17): bicyclic nucleic acid (BNA)
cuguccaagcccgguuga

SEQ ID NO: 10753 - RNA, 18 nt, Artificial Sequence
  Description of Artificial Sequence: Synthetic Antisense oligonucleotide
  misc_feature (3)..(3): bicyclic nucleic acid (BNA)
  misc_feature (11)..(11): bicyclic nucleic acid (BNA)
cuguccaagcccgguuga

SEQ ID NO: 10754 - RNA, 18 nt, Artificial Sequence
  Description of Artificial Sequence: Synthetic Antisense oligonucleotide
  misc_feature (10)..(11): bicyclic nucleic acid (BNA)
cuguccaagcccgguuga

SEQ ID NO: 10755 - RNA, 18 nt, Artificial Sequence
  Description of Artificial Sequence: Synthetic Antisense oligonucleotide
  misc_feature (10)..(10): bicyclic nucleic acid (BNA)
  misc_feature (17)..(17): bicyclic nucleic acid (BNA)
cuguccaagcccgguuga

SEQ ID NO: 10756 - RNA, 18 nt, Artificial Sequence
  Description of Artificial Sequence: Synthetic Antisense oligonucleotide
  misc_feature (12)..(13): bicyclic nucleic acid (BNA)
cuguccaagcccgguuga

SEQ ID NO: 10757 - RNA, 18 nt, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
cuguccaagcccgguuga

SEQ ID NO: 10758 - RNA, 18 nt, Artificial Sequence
  Description of Artificial Sequence: Synthetic Antisense oligonucleotide
  misc_feature (10)..(10): bicyclic nucleic acid (BNA)
  misc_feature (14)..(14): bicyclic nucleic acid (BNA)
cuguccaagcccgguuga

SEQ ID NO: 10759 - RNA, 18 nt, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
cuguccaagcccgguuga

SEQ ID NO: 10760 - RNA, 18 nt, Artificial Sequence
  Description of Artificial Sequence: Synthetic Antisense oligonucleotide
  misc_feature (6)..(6): bicyclic nucleic acid (BNA)
  misc_feature (17)..(17): bicyclic nucleic acid (BNA)
cuguccaagcccgguuga

SEQ ID NO: 10761 - RNA, 18 nt, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
cuguccaagcccgguuga

SEQ ID NO: 10762 - RNA, 18 nt, Artificial Sequence
  Description of Artificial Sequence: Synthetic Antisense oligonucleotide
  misc_feature (11)..(11): bicyclic nucleic acid (BNA)
  misc_feature (17)..(17): bicyclic nucleic acid (BNA)
cuguccaagcccgguuga

SEQ ID NO: 10763 - RNA, 18 nt, Artificial Sequence
  Description of Artificial Sequence: Synthetic Antisense oligonucleotide
  misc_feature (3)..(3): bicyclic nucleic acid (BNA)
  misc_feature (12)..(12): bicyclic nucleic acid (BNA)
cuguccaagcccgguuga

SEQ ID NO: 10764 - RNA, 18 nt, Artificial Sequence
  Description of Artificial Sequence: Synthetic Antisense oligonucleotide
  misc_feature (3)..(3): bicyclic nucleic acid (BNA)
  misc_feature (5)..(5): bicyclic nucleic acid (BNA)
cuguccaagcccgguuga

SEQ ID NO: 10765 - RNA, 18 nt, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
cuguccaagcccgguuga

SEQ ID NO: 10766 - RNA, 20 nt, Artificial Sequence
  Description of Artificial Sequence: Synthetic Antisense oligonucleotide
  misc_feature (2)..(2): bicyclic nucleic acid (BNA)
ucaaggaagauggcauuucu

SEQ ID NO: 10767 - RNA, 20 nt, Artificial Sequence
  Description of Artificial Sequence: Synthetic Antisense oligonucleotide
  misc_feature (9)..(9): bicyclic nucleic acid (BNA)
ucaaggaagauggcauuucu

SEQ ID NO: 10768 - RNA, 20 nt, Artificial Sequence
  Description of Artificial Sequence: Synthetic Antisense oligonucleotide
  misc_feature (5)..(5): bicyclic nucleic acid (BNA)
ucaaggaagauggcauuucu

SEQ ID NO: 10769 - RNA, 20 nt, Artificial Sequence
  Description of Artificial Sequence: Synthetic Antisense oligonucleotide
  misc_feature (6)..(6): bicyclic nucleic acid (BNA)
ucaaggaagauggcauuucu

SEQ ID NO: 10770 - RNA, 20 nt, Artificial Sequence
  Description of Artificial Sequence: Synthetic Antisense oligonucleotide
  misc_feature (12)..(12): bicyclic nucleic acid (BNA)
ucaaggaagauggcauuucu

SEQ ID NO: 10771 - RNA, 20 nt, Artificial Sequence
  Description of Artificial Sequence: Synthetic Antisense oligonucleotide
  misc_feature (13)..(13): bicyclic nucleic acid (BNA)
ucaaggaagauggcauuucu

SEQ ID NO: 10772 - RNA, 20 nt, Artificial Sequence
  Description of Artificial Sequence: Synthetic Antisense oligonucleotide
  misc_feature (19)..(19): bicyclic nucleic acid (BNA)
ucaaggaagauggcauuucu

SEQ ID NO: 10773 - RNA, 20 nt, Artificial Sequence
  Description of Artificial Sequence: Synthetic Antisense oligonucleotide
  misc_feature (14)..(14): bicyclic nucleic acid (BNA)
ucaaggaagauggcauuucu

SEQ ID NO: 10774 - RNA, 22 nt, Artificial Sequence
  Description of Artificial Sequence: Synthetic Antisense oligonucleotide
  misc_feature (2)..(2): bicyclic nucleic acid (BNA)
ucaaggaagauggcauuucuag

SEQ ID NO: 10775 - RNA, 22 nt, Artificial Sequence
  Description of Artificial Sequence: Synthetic Antisense oligonucleotide
  misc_feature (9)..(9): bicyclic nucleic acid (BNA)
ucaaggaagauggcauuucuag

SEQ ID NO: 10776 - RNA, 22 nt, Artificial Sequence
  Description of Artificial Sequence: Synthetic Antisense oligonucleotide
  misc_feature (5)..(5): bicyclic nucleic acid (BNA)
ucaaggaagauggcauuucuag

SEQ ID NO: 10777 - RNA, 22 nt, Artificial Sequence
  Description of Artificial Sequence: Synthetic Antisense oligonucleotide
  misc_feature (6)..(6): bicyclic nucleic acid (BNA)
ucaaggaagauggcauuucuag

SEQ ID NO: 10778 - RNA, 22 nt, Artificial Sequence
  Description of Artificial Sequence: Synthetic Antisense oligonucleotide
  misc_feature (12)..(12): bicyclic nucleic acid (BNA)
ucaaggaagauggcauuucuag

SEQ ID NO: 10779 - RNA, 22 nt, Artificial Sequence
  Description of Artificial Sequence: Synthetic Antisense oligonucleotide
  misc_feature (13)..(13): bicyclic nucleic acid (BNA)
ucaaggaagauggcauuucuag

SEQ ID NO: 10780 - RNA, 22 nt, Artificial Sequence
  Description of Artificial Sequence: Synthetic Antisense oligonucleotide
  misc_feature (19)..(19): bicyclic nucleic acid (BNA)
ucaaggaagauggcauuucuag

SEQ ID NO: 10781 - RNA, 22 nt, Artificial Sequence
  Description of Artificial Sequence: Synthetic Antisense oligonucleotide
  misc_feature (14)..(14): bicyclic nucleic acid (BNA)
ucaaggaagauggcauuucuag

SEQ ID NO: 10782 - RNA, 20 nt, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
ucaaggaagauggcauuucu

SEQ ID NO: 10783 - RNA, 20 nt, Artificial Sequence
  Description of Artificial Sequence: Synthetic Antisense oligonucleotide
  misc_feature (5)..(5): bicyclic nucleic acid (BNA)
  misc_feature (9)..(9): bicyclic nucleic acid (BNA)
ucaaggaagauggcauuucu

SEQ ID NO: 10784 - RNA, 20 nt, Artificial Sequence
  Description of Artificial Sequence: Synthetic Antisense oligonucleotide
  misc_feature (5)..(5): bicyclic nucleic acid (BNA)
  misc_feature (19)..(19): bicyclic nucleic acid (BNA)
ucaaggaagauggcauuucu

SEQ ID NO: 10785 - RNA, 20 nt, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
ucaaggaagauggcauuucu

SEQ ID NO: 10786 - RNA, 20 nt, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
ucaaggaagauggcauuucu

SEQ ID NO: 10787 - RNA, 20 nt, Artificial Sequence
  Description of Artificial Sequence: Synthetic Antisense oligonucleotide
  misc_feature (2)..(2): bicyclic nucleic acid (BNA)
  misc_feature (12)..(12): bicyclic nucleic acid (BNA)
ucaaggaagauggcauuucu

SEQ ID NO: 10788 - RNA, 20 nt, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
ucaaggaagauggcauuucu

SEQ ID NO: 10789 - RNA, 20 nt, Artificial Sequence
  Description of Artificial Sequence: Synthetic Antisense oligonucleotide
  misc_feature (13)..(14): bicyclic nucleic acid (BNA)
ucaaggaagauggcauuucu

SEQ ID NO: 10790 - RNA, 20 nt, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
ucaaggaagauggcauuucu

SEQ ID NO: 10791 - RNA, 20 nt, Artificial Sequence
  Description of Artificial Sequence: Synthetic Antisense oligonucleotide
  misc_feature (6)..(6): bicyclic nucleic acid (BNA)
  misc_feature (19)..(19): bicyclic nucleic acid (BNA)
ucaaggaagauggcauuucu

SEQ ID NO: 10792 - RNA, 20 nt, Artificial Sequence
  Description of Artificial Sequence: Synthetic Antisense oligonucleotide
  misc_feature (5)..(5): bicyclic nucleic acid (BNA)
  misc_feature (14)..(14): bicyclic nucleic acid (BNA)
ucaaggaagauggcauuucu

SEQ ID NO: 10793 - RNA, 20 nt, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
ucaaggaagauggcauuucu

SEQ ID NO: 10794 - RNA, 20 nt, Artificial Sequence
  Description of Artificial Sequence: Synthetic Antisense oligonucleotide
  misc_feature (12)..(12): bicyclic nucleic acid (BNA)
  misc_feature (19)..(19): bicyclic nucleic acid (BNA)
ucaaggaagauggcauuucu

SEQ ID NO: 10795 - RNA, 20 nt, Artificial Sequence
  Description of Artificial Sequence: Synthetic Antisense oligonucleotide
  misc_feature (12)..(12): bicyclic nucleic acid (BNA)
  misc_feature (14)..(14): bicyclic nucleic acid (BNA)
ucaaggaagauggcauuucu

SEQ ID NO: 10796 - RNA, 20 nt, Artificial Sequence
  Description of Artificial Sequence: Synthetic Antisense oligonucleotide
  misc_feature (6)..(6): bicyclic nucleic acid (BNA)
  misc_feature (12)..(12): bicyclic nucleic acid (BNA)
ucaaggaagauggcauuucu

SEQ ID NO: 10797 - RNA, 20 nt, Artificial Sequence
  Description of Artificial Sequence: Synthetic Antisense oligonucleotide
  misc_feature (5)..(6): bicyclic nucleic acid (BNA)
ucaaggaagauggcauuucu

SEQ ID NO: 10798 - RNA, 20 nt, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
ucaaggaagauggcauuucu

SEQ ID NO: 10799 - RNA, 20 nt, Artificial Sequence
  Description of Artificial Sequence: Synthetic Antisense oligonucleotide
  misc_feature (9)..(9): bicyclic nucleic acid (BNA)
  misc_feature (12)..(12): bicyclic nucleic acid (BNA)
ucaaggaagauggcauuucu

SEQ ID NO: 10800 - RNA, 20 nt, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
ucaaggaagauggcauuucu

SEQ ID NO: 10801 - RNA, 20 nt, Artificial Sequence
  Description of Artificial Sequence: Synthetic Antisense oligonucleotide
  misc_feature (13)..(13): bicyclic nucleic acid (BNA)
  misc_feature (19)..(19): bicyclic nucleic acid (BNA)
ucaaggaagauggcauuucu

SEQ ID NO: 10802 - RNA, 20 nt, Artificial Sequence
  Description of Artificial Sequence: Synthetic Antisense oligonucleotide
  misc_feature (12)..(13): bicyclic nucleic acid (BNA)
ucaaggaagauggcauuucu

SEQ ID NO: 10803 - RNA, 20 nt, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
ucaaggaagauggcauuucu

SEQ ID NO: 10804 - RNA, 20 nt, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
ucaaggaagauggcauuucu

SEQ ID NO: 10805 - RNA, 20 nt, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
ucaaggaagauggcauuucu

SEQ ID NO: 10806 - RNA, 20 nt, Artificial Sequence
  Description of Artificial Sequence: Synthetic Antisense oligonucleotide
  misc_feature (2)..(2): bicyclic nucleic acid (BNA)
  misc_feature (19)..(19): bicyclic nucleic acid (BNA)
ucaaggaagauggcauuucu

SEQ ID NO: 10807 - RNA, 20 nt, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
ucaaggaagauggcauuucu

SEQ ID NO: 10808 - RNA, 20 nt, Artificial Sequence
  Description of Artificial Sequence: Synthetic Antisense oligonucleotide
  misc_feature (14)..(14): bicyclic nucleic acid (BNA)
  misc_feature (19)..(19): bicyclic nucleic acid (BNA)
ucaaggaagauggcauuucu

SEQ ID NO: 10809 - RNA, 20 nt, Artificial Sequence
  Description of Artificial Sequence: Synthetic Antisense oligonucleotide
  misc_feature (9)..(9): bicyclic nucleic acid (BNA)
  misc_feature (19)..(19): bicyclic nucleic acid (BNA)
ucaaggaagauggcauuucu

SEQ ID NO: 10810 - RNA, 22 nt, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
ucaaggaagauggcauuucuag

SEQ ID NO: 10811 - RNA, 22 nt, Artificial Sequence
  Description of Artificial Sequence: Synthetic Antisense oligonucleotide
  misc_feature (5)..(5): bicyclic nucleic acid (BNA)
  misc_feature (9)..(9): bicyclic nucleic acid (BNA)
ucaaggaagauggcauuucuag

SEQ ID NO: 10812 - RNA, 22 nt, Artificial Sequence
  Description of Artificial Sequence: Synthetic Antisense oligonucleotide
  misc_feature (5)..(5): bicyclic nucleic acid (BNA)
  misc_feature (19)..(19): bicyclic nucleic acid (BNA)
ucaaggaagauggcauuucuag

SEQ ID NO: 10813 - RNA, 22 nt, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
ucaaggaagauggcauuucuag

SEQ ID NO: 10814 - RNA, 22 nt, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
ucaaggaagauggcauuucuag

SEQ ID NO: 10815 - RNA, 22 nt, Artificial Sequence
  Description of Artificial Sequence: Synthetic Antisense oligonucleotide
  misc_feature (2)..(2): bicyclic nucleic acid (BNA)
  misc_feature (12)..(12): bicyclic nucleic acid (BNA)
ucaaggaagauggcauuucuag

SEQ ID NO: 10816 - RNA, 22 nt, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
ucaaggaagauggcauuucuag

SEQ ID NO: 10817 - RNA, 22 nt, Artificial Sequence
  Description of Artificial Sequence: Synthetic Antisense oligonucleotide
  misc_feature (13)..(14): bicyclic nucleic acid (BNA)
ucaaggaagauggcauuucuag

SEQ ID NO: 10818 - RNA, 22 nt, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
ucaaggaagauggcauuucuag

SEQ ID NO: 10819 - RNA, 22 nt, Artificial Sequence
  Description of Artificial Sequence: Synthetic Antisense oligonucleotide
  misc_feature (6)..(6): bicyclic nucleic acid (BNA)
  misc_feature (19)..(19): bicyclic nucleic acid (BNA)
ucaaggaagauggcauuucuag

SEQ ID NO: 10820 - RNA, 22 nt, Artificial Sequence
  Description of Artificial Sequence: Synthetic Antisense oligonucleotide
  misc_feature (5)..(5): bicyclic nucleic acid (BNA)
  misc_feature (14)..(14): bicyclic nucleic acid (BNA)
ucaaggaagauggcauuucuag

SEQ ID NO: 10821 - RNA, 22 nt, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
ucaaggaagauggcauuucuag

SEQ ID NO: 10822 - RNA, 22 nt, Artificial Sequence
  Description of Artificial Sequence: Synthetic Antisense oligonucleotide
  misc_feature (12)..(12): bicyclic nucleic acid (BNA)
  misc_feature (19)..(19): bicyclic nucleic acid (BNA)
ucaaggaagauggcauuucuag

SEQ ID NO: 10823 - RNA, 22 nt, Artificial Sequence
  Description of Artificial Sequence: Synthetic Antisense oligonucleotide
  misc_feature (12)..(12): bicyclic nucleic acid (BNA)
  misc_feature (14)..(14): bicyclic nucleic acid (BNA)
ucaaggaagauggcauuucuag

SEQ ID NO: 10824 - RNA, 22 nt, Artificial Sequence
  Description of Artificial Sequence: Synthetic Antisense oligonucleotide
  misc_feature (6)..(6): bicyclic nucleic acid (BNA)
  misc_feature (12)..(12): bicyclic nucleic acid (BNA)
ucaaggaagauggcauuucuag

SEQ ID NO: 10825 - RNA, 22 nt, Artificial Sequence
  Description of Artificial Sequence: Synthetic Antisense oligonucleotide
  misc_feature (5)..(6): bicyclic nucleic acid (BNA)
ucaaggaagauggcauuucuag

SEQ ID NO: 10826 - RNA, 22 nt, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
ucaaggaagauggcauuucuag

SEQ ID NO: 10827 - RNA, 22 nt, Artificial Sequence
  Description of Artificial Sequence: Synthetic Antisense oligonucleotide
  misc_feature (9)..(9): bicyclic nucleic acid (BNA)
  misc_feature (12)..(12): bicyclic nucleic acid (BNA)
ucaaggaagauggcauuucuag

SEQ ID NO: 10828 - RNA, 22 nt, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
ucaaggaagauggcauuucuag

SEQ ID NO: 10829 - RNA, 22 nt, Artificial Sequence
  Description of Artificial Sequence: Synthetic Antisense oligonucleotide
  misc_feature (13)..(13): bicyclic nucleic acid (BNA)
  misc_feature (19)..(19): bicyclic nucleic acid (BNA)
ucaaggaagauggcauuucuag

SEQ ID NO: 10830 - RNA, 22 nt, Artificial Sequence
  Description of Artificial Sequence: Synthetic Antisense oligonucleotide
  misc_feature (12)..(13): bicyclic nucleic acid (BNA)
ucaaggaagauggcauuucuag

SEQ ID NO: 10831 - RNA, 22 nt, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
ucaaggaagauggcauuucuag

SEQ ID NO: 10832 - RNA, 22 nt, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
ucaaggaagauggcauuucuag

SEQ ID NO: 10833 - RNA, 22 nt, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
ucaaggaagauggcauuucuag

SEQ ID NO: 10834 - RNA, 22 nt, Artificial Sequence
  Description of Artificial Sequence: Synthetic Antisense oligonucleotide
  misc_feature (2)..(2): bicyclic nucleic acid (BNA)
  misc_feature (19)..(19): bicyclic nucleic acid (BNA)
ucaaggaagauggcauuucuag

SEQ ID NO: 10835 - RNA, 22 nt, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
ucaaggaagauggcauuucuag

SEQ ID NO: 10836 - RNA, 22 nt, Artificial Sequence
  Description of Artificial Sequence: Synthetic Antisense oligonucleotide
  misc_feature (14)..(14): bicyclic nucleic acid (BNA)
  misc_feature (19)..(19): bicyclic nucleic acid (BNA)
ucaaggaagauggcauuucuag

SEQ ID NO: 10837 - RNA, 22 nt, Artificial Sequence
  Description of Artificial Sequence: Synthetic Antisense oligonucleotide
  misc_feature (9)..(9): bicyclic nucleic acid (BNA)
  misc_feature (19)..(19): bicyclic nucleic acid (BNA)
ucaaggaagauggcauuucuag

SEQ ID NO: 10838 - RNA, 18 nt, Artificial Sequence
  Description of Artificial Sequence: Synthetic Antisense oligonucleotide
  misc_feature (2)..(2): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 10839 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
gguaaguucuguccaagc

SEQ ID NO: 10840 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
gguaaguucuguccaagc

SEQ ID NO: 10841 - RNA, 18 nt, Artificial Sequence
  Description of Artificial Sequence: Synthetic Antisense oligonucleotide
  misc_feature (6)..(6): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 10842 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (17)..(17): bicyclic nucleic acid (BNA)
gguaaguucuguccaagc

SEQ ID NO: 10843 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (13)..(13): bicyclic nucleic acid (BNA)
gguaaguucuguccaagc

SEQ ID NO: 10844 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (14)..(14): bicyclic nucleic acid (BNA)
gguaaguucuguccaagc

SEQ ID NO: 10845 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (16)..(16): bicyclic nucleic acid (BNA)
guaaguucuguccaagcc

SEQ ID NO: 10846 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
guaaguucuguccaagcc

SEQ ID NO: 10847 - RNA, 18 nt, Artificial Sequence
  Description of Artificial Sequence: Synthetic Antisense oligonucleotide
  misc_feature (5)..(5): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 10848 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (17)..(17): bicyclic nucleic acid (BNA)
guaaguucuguccaagcc

SEQ ID NO: 10849 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(12): bicyclic nucleic acid (BNA)
guaaguucuguccaagcc

SEQ ID NO: 10850 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (13)..(13): bicyclic nucleic acid (BNA)
guaaguucuguccaagcc

SEQ ID NO: 10851 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
guaaguucuguccaagcc

SEQ ID NO: 10852 - RNA, 18 nt, Artificial Sequence
  Description of Artificial Sequence: Synthetic Antisense oligonucleotide
  misc_feature (2)..(2): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 10853 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
agucgguaaguucugucc

SEQ ID NO: 10854 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
agucgguaaguucugucc

SEQ ID NO: 10855 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
agucgguaaguucugucc

SEQ ID NO: 10856 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
agucgguaaguucugucc

SEQ ID NO: 10857 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (17)..(17): bicyclic nucleic acid (BNA)
agucgguaaguucugucc

SEQ ID NO: 10858 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (13)..(13): bicyclic nucleic acid (BNA)
agucgguaaguucugucc

SEQ ID NO: 10859 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (15)..(15): bicyclic nucleic acid (BNA)
agucgguaaguucugucc

SEQ ID NO: 10860 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
cuguccaagcccgguuga

SEQ ID NO: 10861 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
cuguccaagcccgguuga

SEQ ID NO: 10862 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
cuguccaagcccgguuga

SEQ ID NO: 10863 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
cuguccaagcccgguuga

SEQ ID NO: 10864 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
cuguccaagcccgguuga

SEQ ID NO: 10865 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
cuguccaagcccgguuga

SEQ ID NO: 10866 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (17)..(17): bicyclic nucleic acid (BNA)
cuguccaagcccgguuga

SEQ ID NO: 10867 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(12): bicyclic nucleic acid (BNA)
cuguccaagcccgguuga

SEQ ID NO: 10868 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(13): bicyclic nucleic acid (BNA)
cuguccaagcccgguuga

SEQ ID NO: 10869 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (14)..(14): bicyclic nucleic acid (BNA)
cuguccaagcccgguuga

SEQ ID NO: 10870 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (14)..(14): bicyclic nucleic acid (BNA)
gguaaguucuguccaagc

SEQ ID NO: 10871 - RNA, 18 nt, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 10872 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (13)..(13): bicyclic nucleic acid (BNA)
  misc_feature (17)..(17): bicyclic nucleic acid (BNA)
gguaaguucuguccaagc

SEQ ID NO: 10873 - RNA, 18 nt, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 10874 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (13)..(14): bicyclic nucleic acid (BNA)
gguaaguucuguccaagc

SEQ ID NO: 10875 - RNA, 18 nt, Artificial Sequence
  Description of Artificial Sequence: Synthetic Antisense oligonucleotide
  misc_feature (2)..(2): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 10876 - RNA, 18 nt, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 10877 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (11)..(11): bicyclic nucleic acid (BNA)
gguaaguucuguccaagc

SEQ ID NO: 10878 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (14)..(14): bicyclic nucleic acid (BNA)
  misc_feature (17)..(17): bicyclic nucleic acid (BNA)
gguaaguucuguccaagc

SEQ ID NO: 10879 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (13)..(13): bicyclic nucleic acid (BNA)
gguaaguucuguccaagc

SEQ ID NO: 10880 - RNA, 18 nt, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 10881 - RNA, 18 nt, Artificial Sequence
  Description of Artificial Sequence: Synthetic Antisense oligonucleotide
  misc_feature (2)..(2): bicyclic nucleic acid (BNA)
  misc_feature (11)..(11): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 10882 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (17)..(17): bicyclic nucleic acid (BNA)
gguaaguucuguccaagc

SEQ ID NO: 10883 - RNA, 18 nt, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 10884 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (14)..(14): bicyclic nucleic acid (BNA)
gguaaguucuguccaagc

SEQ ID NO: 10885 - RNA, 18 nt, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 10886 - RNA, 18 nt, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 10887 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (13)..(13): bicyclic nucleic acid (BNA)
gguaaguucuguccaagc

SEQ ID NO: 10888 - RNA, 18 nt, Artificial Sequence
  Description of Artificial Sequence: Synthetic Antisense oligonucleotide
  misc_feature (6)..(6): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 10889 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (17)..(17): bicyclic nucleic acid (BNA)
gguaaguucuguccaagc

SEQ ID NO: 10890 - RNA, 18 nt, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 10891 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(12): bicyclic nucleic acid (BNA)
  misc_feature (17)..(17): bicyclic nucleic acid (BNA)
guaaguucuguccaagcc

SEQ ID NO: 10892 - RNA, 18 nt, Artificial Sequence
  Description of Artificial Sequence: Synthetic Antisense oligonucleotide
  misc_feature (5)..(5): bicyclic nucleic acid (BNA)
  misc_feature (8)..(8): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 10893 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (13)..(13): bicyclic nucleic acid (BNA)
guaaguucuguccaagcc

SEQ ID NO: 10894 - RNA, 18 nt, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 10895 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (17)..(17): bicyclic nucleic acid (BNA)
guaaguucuguccaagcc

SEQ ID NO: 10896 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (13)..(13): bicyclic nucleic acid (BNA)
  misc_feature (17)..(17): bicyclic nucleic acid (BNA)
guaaguucuguccaagcc

SEQ ID NO: 10897 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (12)..(12): bicyclic nucleic acid (BNA)
guaaguucuguccaagcc

SEQ ID NO: 10898 - RNA, 18 nt, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 10899 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (16)..(16): bicyclic nucleic acid (BNA)
guaaguucuguccaagcc

SEQ ID NO: 10900 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (16)..(16): bicyclic nucleic acid (BNA)
guaaguucuguccaagcc

SEQ ID NO: 10901 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (12)..(12): bicyclic nucleic acid (BNA)
guaaguucuguccaagcc

SEQ ID NO: 10902 - RNA, 18 nt, Artificial Sequence
  Description of Artificial Sequence: Synthetic Antisense oligonucleotide
  misc_feature (5)..(5): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 10903 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (17)..(17): bicyclic nucleic acid (BNA)
guaaguucuguccaagcc

SEQ ID NO: 10904 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(13): bicyclic nucleic acid (BNA)
guaaguucuguccaagcc

SEQ ID NO: 10905 - RNA, 18 nt, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 10906 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (10)..(10): bicyclic nucleic acid (BNA)
guaaguucuguccaagcc

SEQ ID NO: 10907 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (13)..(13): bicyclic nucleic acid (BNA)
  misc_feature (16)..(16): bicyclic nucleic acid (BNA)
guaaguucuguccaagcc

SEQ ID NO: 10908 - RNA, 18 nt, Artificial Sequence
  Description of Artificial Sequence: Synthetic Antisense oligonucleotide
  misc_feature (5)..(5): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 10909 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(12): bicyclic nucleic acid (BNA)
  misc_feature (16)..(16): bicyclic nucleic acid (BNA)
guaaguucuguccaagcc

SEQ ID NO: 10910 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (16)..(17): bicyclic nucleic acid (BNA)
guaaguucuguccaagcc

SEQ ID NO: 10911 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (13)..(13): bicyclic nucleic acid (BNA)
guaaguucuguccaagcc

SEQ ID NO: 10912 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (10)..(10): bicyclic nucleic acid (BNA)
agucgguaaguucugucc

SEQ ID NO: 10913 - RNA, 18 nt, Artificial Sequence
  Description of Artificial Sequence: Synthetic Antisense oligonucleotide
  misc_feature (2)..(2): bicyclic nucleic acid (BNA)
  misc_feature (4)..(4): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 10914 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (13)..(13): bicyclic nucleic acid (BNA)
agucgguaaguucugucc

SEQ ID NO: 10915 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (13)..(13): bicyclic nucleic acid (BNA)
  misc_feature (17)..(17): bicyclic nucleic acid (BNA)
agucgguaaguucugucc

SEQ ID NO: 10916 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (15)..(15): bicyclic nucleic acid (BNA)
agucgguaaguucugucc

SEQ ID NO: 10917 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (10)..(10): bicyclic nucleic acid (BNA)
agucgguaaguucugucc

SEQ ID NO: 10918 - RNA, 18 nt, Artificial Sequence
  Description of Artificial Sequence: Synthetic Antisense oligonucleotide
  misc_feature (2)..(2): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 10919 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (13)..(13): bicyclic nucleic acid (BNA)
agucgguaaguucugucc

SEQ ID NO: 10920 - RNA, 18 nt, Artificial Sequence
  Description of Artificial Sequence: Synthetic Antisense oligonucleotide
  misc_feature (2)..(2): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 10921 - RNA, 18 nt, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 10922 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (17)..(17): bicyclic nucleic acid (BNA)
agucgguaaguucugucc

SEQ ID NO: 10923 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (15)..(15): bicyclic nucleic acid (BNA)
agucgguaaguucugucc

SEQ ID NO: 10924 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (13)..(13): bicyclic nucleic acid (BNA)
  misc_feature (15)..(15): bicyclic nucleic acid (BNA)
agucgguaaguucugucc

SEQ ID NO: 10925 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(6): bicyclic nucleic acid (BNA)
agucgguaaguucugucc

SEQ ID NO: 10926 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (15)..(15): bicyclic nucleic acid (BNA)
agucgguaaguucugucc

SEQ ID NO: 10927 - RNA, 18 nt, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 10928 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (17)..(17): bicyclic nucleic acid (BNA)
agucgguaaguucugucc

SEQ ID NO: 10929 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (17)..(17): bicyclic nucleic acid (BNA)
agucgguaaguucugucc

SEQ ID NO: 10930 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (10)..(10): bicyclic nucleic acid (BNA)
agucgguaaguucugucc

SEQ ID NO: 10931 - RNA, 18 nt, Artificial Sequence
  Description of Artificial Sequence: Synthetic Antisense oligonucleotide
  misc_feature (2)..(2): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 10932 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (6)..(6): bicyclic nucleic acid (BNA)
agucgguaaguucugucc

SEQ ID NO: 10933 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (13)..(13): bicyclic nucleic acid (BNA)
agucgguaaguucugucc

SEQ ID NO: 10934 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (15)..(15): bicyclic nucleic acid (BNA)
  misc_feature (17)..(17): bicyclic nucleic acid (BNA)
agucgguaaguucugucc

SEQ ID NO: 10935 - RNA, 18 nt, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 10936 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (17)..(17): bicyclic nucleic acid (BNA)
agucgguaaguucugucc

SEQ ID NO: 10937 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (15)..(15): bicyclic nucleic acid (BNA)
agucgguaaguucugucc

SEQ ID NO: 10938 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(5): bicyclic nucleic acid (BNA)
agucgguaaguucugucc

SEQ ID NO: 10939 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (13)..(13): bicyclic nucleic acid (BNA)
agucgguaaguucugucc

SEQ ID NO: 10940 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(12): bicyclic nucleic acid (BNA)
  misc_feature (17)..(17): bicyclic nucleic acid (BNA)
cuguccaagcccgguuga

SEQ ID NO: 10941 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (10)..(10): bicyclic nucleic acid (BNA)
cuguccaagcccgguuga

SEQ ID NO: 10942 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (14)..(14): bicyclic nucleic acid (BNA)
cuguccaagcccgguuga

SEQ ID NO: 10943 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(12): bicyclic nucleic acid (BNA)
cuguccaagcccgguuga

SEQ ID NO: 10944 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (9)..(9): bicyclic nucleic acid (BNA)
cuguccaagcccgguuga

SEQ ID NO: 10945 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (9)..(9): bicyclic nucleic acid (BNA)
cuguccaagcccgguuga

SEQ ID NO: 10946 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (14)..(14): bicyclic nucleic acid (BNA)
cuguccaagcccgguuga

SEQ ID NO: 10947 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(10): bicyclic nucleic acid (BNA)
cuguccaagcccgguuga

SEQ ID NO: 10948 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (13)..(13): bicyclic nucleic acid (BNA)
cuguccaagcccgguuga

SEQ ID NO: 10949 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (13)..(13): bicyclic nucleic acid (BNA)
cuguccaagcccgguuga

SEQ ID NO: 10950 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(13): bicyclic nucleic acid (BNA)
  misc_feature (17)..(17): bicyclic nucleic acid (BNA)
cuguccaagcccgguuga

SEQ ID NO: 10951 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (6)..(6): bicyclic nucleic acid (BNA)
cuguccaagcccgguuga

SEQ ID NO: 10952 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (9)..(9): bicyclic nucleic acid (BNA)
cuguccaagcccgguuga

SEQ ID NO: 10953 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (10)..(10): bicyclic nucleic acid (BNA)
cuguccaagcccgguuga

SEQ ID NO: 10954 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (10)..(10): bicyclic nucleic acid (BNA)
cuguccaagcccgguuga

SEQ ID NO: 10955 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(14): bicyclic nucleic acid (BNA)
cuguccaagcccgguuga

SEQ ID NO: 10956 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (13)..(13): bicyclic nucleic acid (BNA)
cuguccaagcccgguuga

SEQ ID NO: 10957 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (11)..(11): bicyclic nucleic acid (BNA)
cuguccaagcccgguuga

SEQ ID NO: 10958 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (14)..(14): bicyclic nucleic acid (BNA)
  misc_feature (17)..(17): bicyclic nucleic acid (BNA)
cuguccaagcccgguuga

SEQ ID NO: 10959 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (13)..(13): bicyclic nucleic acid (BNA)
cuguccaagcccgguuga

SEQ ID NO: 10960 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (14)..(14): bicyclic nucleic acid (BNA)
cuguccaagcccgguuga

SEQ ID NO: 10961 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (14)..(14): bicyclic nucleic acid (BNA)
cuguccaagcccgguuga

SEQ ID NO: 10962 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (12)..(12): bicyclic nucleic acid (BNA)
cuguccaagcccgguuga

SEQ ID NO: 10963 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (17)..(17): bicyclic nucleic acid (BNA)
cuguccaagcccgguuga

SEQ ID NO: 10964 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(12): bicyclic nucleic acid (BNA)
  misc_feature (14)..(14): bicyclic nucleic acid (BNA)
cuguccaagcccgguuga

SEQ ID NO: 10965 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (11)..(11): bicyclic nucleic acid (BNA)
cuguccaagcccgguuga

SEQ ID NO: 10966 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (17)..(17): bicyclic nucleic acid (BNA)
cuguccaagcccgguuga

SEQ ID NO: 10967 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (12)..(12): bicyclic nucleic acid (BNA)
cuguccaagcccgguuga

SEQ ID NO: 10968 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(6): bicyclic nucleic acid (BNA)
cuguccaagcccgguuga

SEQ ID NO: 10969 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (14)..(14): bicyclic nucleic acid (BNA)
cuguccaagcccgguuga

SEQ ID NO: 10970 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (12)..(12): bicyclic nucleic acid (BNA)
cuguccaagcccgguuga

SEQ ID NO: 10971 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (17)..(17): bicyclic nucleic acid (BNA)
cuguccaagcccgguuga

SEQ ID NO: 10972 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (11)..(11): bicyclic nucleic acid (BNA)
cuguccaagcccgguuga

SEQ ID NO: 10973 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(11): bicyclic nucleic acid (BNA)
cuguccaagcccgguuga

SEQ ID NO: 10974 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (17)..(17): bicyclic nucleic acid (BNA)
cuguccaagcccgguuga

SEQ ID NO: 10975 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(13): bicyclic nucleic acid (BNA)
cuguccaagcccgguuga

SEQ ID NO: 10976 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (12)..(12): bicyclic nucleic acid (BNA)
cuguccaagcccgguuga

SEQ ID NO: 10977 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (14)..(14): bicyclic nucleic acid (BNA)
cuguccaagcccgguuga

SEQ ID NO: 10978 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (11)..(11): bicyclic nucleic acid (BNA)
cuguccaagcccgguuga

SEQ ID NO: 10979 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (17)..(17): bicyclic nucleic acid (BNA)
cuguccaagcccgguuga

SEQ ID NO: 10980 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (13)..(13): bicyclic nucleic acid (BNA)
cuguccaagcccgguuga

SEQ ID NO: 10981 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (17)..(17): bicyclic nucleic acid (BNA)
cuguccaagcccgguuga

SEQ ID NO: 10982 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (12)..(12): bicyclic nucleic acid (BNA)
cuguccaagcccgguuga

SEQ ID NO: 10983 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (5)..(5): bicyclic nucleic acid (BNA)
cuguccaagcccgguuga

SEQ ID NO: 10984 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (13)..(13): bicyclic nucleic acid (BNA)
cuguccaagcccgguuga

SEQ ID NO: 10985 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
ucaaggaagauggcauuucu

SEQ ID NO: 10986 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
ucaaggaagauggcauuucu

SEQ ID NO: 10987 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
ucaaggaagauggcauuucu

SEQ ID NO: 10988 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
ucaaggaagauggcauuucu

SEQ ID NO: 10989 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
ucaaggaagauggcauuucu

SEQ ID NO: 10990 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
ucaaggaagauggcauuucu

SEQ ID NO: 10991 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (19)..(19): bicyclic nucleic acid (BNA)
ucaaggaagauggcauuucu

SEQ ID NO: 10992 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
ucaaggaagauggcauuucu

SEQ ID NO: 10993 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
ucaaggaagauggcauuucuag

SEQ ID NO: 10994 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
ucaaggaagauggcauuucuag

SEQ ID NO: 10995 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
ucaaggaagauggcauuucuag

SEQ ID NO: 10996 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
ucaaggaagauggcauuucuag

SEQ ID NO: 10997 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
ucaaggaagauggcauuucuag

SEQ ID NO: 10998 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
ucaaggaagauggcauuucuag

SEQ ID NO: 10999 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (19)..(19): bicyclic nucleic acid (BNA)
ucaaggaagauggcauuucuag

SEQ ID NO: 11000 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
ucaaggaagauggcauuucuag

SEQ ID NO: 11001 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (14)..(14): bicyclic nucleic acid (BNA)
ucaaggaagauggcauuucu

SEQ ID NO: 11002 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (9)..(9): bicyclic nucleic acid (BNA)
ucaaggaagauggcauuucu

SEQ ID NO: 11003 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (19)..(19): bicyclic nucleic acid (BNA)
ucaaggaagauggcauuucu

SEQ ID NO: 11004 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (14)..(14): bicyclic nucleic acid (BNA)
ucaaggaagauggcauuucu

SEQ ID NO: 11005 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (13)..(13): bicyclic nucleic acid (BNA)
ucaaggaagauggcauuucu

SEQ ID NO: 11006 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (12)..(12): bicyclic nucleic acid (BNA)
ucaaggaagauggcauuucu

SEQ ID NO: 11007 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (9)..(9): bicyclic nucleic acid (BNA)
ucaaggaagauggcauuucu

SEQ ID NO: 11008 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(14): bicyclic nucleic acid (BNA)
ucaaggaagauggcauuucu

SEQ ID NO: 11009 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (13)..(13): bicyclic nucleic acid (BNA)
ucaaggaagauggcauuucu

SEQ ID NO: 11010 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (19)..(19): bicyclic nucleic acid (BNA)
ucaaggaagauggcauuucu

SEQ ID NO: 11011 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (14)..(14): bicyclic nucleic acid (BNA)
ucaaggaagauggcauuucu

SEQ ID NO: 11012 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (6)..(6): bicyclic nucleic acid (BNA)
ucaaggaagauggcauuucu

SEQ ID NO: 11013 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (19)..(19): bicyclic nucleic acid (BNA)
ucaaggaagauggcauuucu

SEQ ID NO: 11014 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (14)..(14): bicyclic nucleic acid (BNA)
ucaaggaagauggcauuucu

SEQ ID NO: 11015 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (12)..(12): bicyclic nucleic acid (BNA)
ucaaggaagauggcauuucu

SEQ ID NO: 11016 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(6): bicyclic nucleic acid (BNA)
ucaaggaagauggcauuucu

SEQ ID NO: 11017 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (14)..(14): bicyclic nucleic acid (BNA)
ucaaggaagauggcauuucu

SEQ ID NO: 11018 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (12)..(12): bicyclic nucleic acid (BNA)
ucaaggaagauggcauuucu

SEQ ID NO: 11019 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (5)..(5): bicyclic nucleic acid (BNA)
ucaaggaagauggcauuucu

SEQ ID NO: 11020 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
  misc_feature (19)..(19): bicyclic nucleic acid (BNA)
ucaaggaagauggcauuucu

SEQ ID NO: 11021 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(13): bicyclic nucleic acid (BNA)
ucaaggaagauggcauuucu

SEQ ID NO: 11022 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (12)..(12): bicyclic nucleic acid (BNA)
ucaaggaagauggcauuucu

SEQ ID NO: 11023 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (13)..(13): bicyclic nucleic acid (BNA)
ucaaggaagauggcauuucu

SEQ ID NO: 11024 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (13)..(13): bicyclic nucleic acid (BNA)
ucaaggaagauggcauuucu

SEQ ID NO: 11025 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (19)..(19): bicyclic nucleic acid (BNA)
ucaaggaagauggcauuucu

SEQ ID NO: 11026 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (9)..(9): bicyclic nucleic acid (BNA)
ucaaggaagauggcauuucu

SEQ ID NO: 11027 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
  misc_feature (19)..(19): bicyclic nucleic acid (BNA)
ucaaggaagauggcauuucu

SEQ ID NO: 11028 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (19)..(19): bicyclic nucleic acid (BNA)
ucaaggaagauggcauuucu

SEQ ID NO: 11029 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (14)..(14): bicyclic nucleic acid (BNA)
ucaaggaagauggcauuucuag

SEQ ID NO: 11030 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (9)..(9): bicyclic nucleic acid (BNA)
ucaaggaagauggcauuucuag

SEQ ID NO: 11031 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (19)..(19): bicyclic nucleic acid (BNA)
ucaaggaagauggcauuucuag

SEQ ID NO: 11032 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (14)..(14): bicyclic nucleic acid (BNA)
ucaaggaagauggcauuucuag

SEQ ID NO: 11033 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (13)..(13): bicyclic nucleic acid (BNA)
ucaaggaagauggcauuucuag

SEQ ID NO: 11034 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (12)..(12): bicyclic nucleic acid (BNA)
ucaaggaagauggcauuucuag

SEQ ID NO: 11035 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (9)..(9): bicyclic nucleic acid (BNA)
ucaaggaagauggcauuucuag

SEQ ID NO: 11036 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(14): bicyclic nucleic acid (BNA)
ucaaggaagauggcauuucuag

SEQ ID NO: 11037 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (13)..(13): bicyclic nucleic acid (BNA)
ucaaggaagauggcauuucuag

SEQ ID NO: 11038 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (19)..(19): bicyclic nucleic acid (BNA)
ucaaggaagauggcauuucuag

SEQ ID NO: 11039 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (14)..(14): bicyclic nucleic acid (BNA)
ucaaggaagauggcauuucuag

SEQ ID NO: 11040 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (6)..(6): bicyclic nucleic acid (BNA)
ucaaggaagauggcauuucuag

SEQ ID NO: 11041 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (19)..(19): bicyclic nucleic acid (BNA)
ucaaggaagauggcauuucuag

SEQ ID NO: 11042 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (14)..(14): bicyclic nucleic acid (BNA)
ucaaggaagauggcauuucuag

SEQ ID NO: 11043 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (12)..(12): bicyclic nucleic acid (BNA)
ucaaggaagauggcauuucuag

SEQ ID NO: 11044 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(6): bicyclic nucleic acid (BNA)
ucaaggaagauggcauuucuag

SEQ ID NO: 11045 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (14)..(14): bicyclic nucleic acid (BNA)
ucaaggaagauggcauuucuag

SEQ ID NO: 11046 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (12)..(12): bicyclic nucleic acid (BNA)
ucaaggaagauggcauuucuag

SEQ ID NO: 11047 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (5)..(5): bicyclic nucleic acid (BNA)
ucaaggaagauggcauuucuag

SEQ ID NO: 11048 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
  misc_feature (19)..(19): bicyclic nucleic acid (BNA)
ucaaggaagauggcauuucuag

SEQ ID NO: 11049 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(13): bicyclic nucleic acid (BNA)
ucaaggaagauggcauuucuag

SEQ ID NO: 11050 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (12)..(12): bicyclic nucleic acid (BNA)
ucaaggaagauggcauuucuag

SEQ ID NO: 11051 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (13)..(13): bicyclic nucleic acid (BNA)
ucaaggaagauggcauuucuag

SEQ ID NO: 11052 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (13)..(13): bicyclic nucleic acid (BNA)
ucaaggaagauggcauuucuag

SEQ ID NO: 11053 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (19)..(19): bicyclic nucleic acid (BNA)
ucaaggaagauggcauuucuag

SEQ ID NO: 11054 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (9)..(9): bicyclic nucleic acid (BNA)
ucaaggaagauggcauuucuag

SEQ ID NO: 11055 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
  misc_feature (19)..(19): bicyclic nucleic acid (BNA)
ucaaggaagauggcauuucuag

SEQ ID NO: 11056 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (19)..(19): bicyclic nucleic acid (BNA)
ucaaggaagauggcauuucuag

SEQ ID NO: 11057 - DNA, 18 bp, Artificial Sequence
  Description of Artificial Sequence: Synthetic Antisense oligonucleotide
  misc_feature (2)..(2): bicyclic nucleic acid (BNA)
ggtaagttctgtccaagc

SEQ ID NO: 11058 - DNA, 18 bp, Artificial Sequence
  Description of Artificial Sequence: Synthetic Antisense oligonucleotide
  misc_feature (9)..(9): bicyclic nucleic acid (BNA)
ggtaagttctgtccaagc

SEQ ID NO: 11059 - DNA, 18 bp, Artificial Sequence
  Description of Artificial Sequence: Synthetic Antisense oligonucleotide
  misc_feature (11)..(11): bicyclic nucleic acid (BNA)
ggtaagttctgtccaagc

SEQ ID NO: 11060 - DNA, 18 bp, Artificial Sequence
  Description of Artificial Sequence: Synthetic Antisense oligonucleotide
  misc_feature (6)..(6): bicyclic nucleic acid (BNA)
ggtaagttctgtccaagc

SEQ ID NO: 11061 - DNA, 18 bp, Artificial Sequence
  Description of Artificial Sequence: Synthetic Antisense oligonucleotide
  misc_feature (17)..(17): bicyclic nucleic acid (BNA)
ggtaagttctgtccaagc

SEQ ID NO: 11062 - DNA, 18 bp, Artificial Sequence
  Description of Artificial Sequence: Synthetic Antisense oligonucleotide
  misc_feature (13)..(13): bicyclic nucleic acid (BNA)
ggtaagttctgtccaagc

SEQ ID NO: 11063 - DNA, 18 bp, Artificial Sequence
  Description of Artificial Sequence: Synthetic Antisense oligonucleotide
  misc_feature (14)..(14): bicyclic nucleic acid (BNA)
ggtaagttctgtccaagc

SEQ ID NO: 11064 - DNA, 18 bp, Artificial Sequence
  Description of Artificial Sequence: Synthetic Antisense oligonucleotide
  misc_feature (16)..(16): bicyclic nucleic acid (BNA)
gtaagttctgtccaagcc

SEQ ID NO: 11065 - DNA, 18 bp, Artificial Sequence
  Description of Artificial Sequence: Synthetic Antisense oligonucleotide
  misc_feature (10)..(10): bicyclic nucleic acid (BNA)
gtaagttctgtccaagcc

SEQ ID NO: 11066 - DNA, 18 bp, Artificial Sequence
  Description of Artificial Sequence: Synthetic Antisense oligonucleotide
  misc_feature (5)..(5): bicyclic nucleic acid (BNA)
gtaagttctgtccaagcc

SEQ ID NO: 11067 - DNA, 18 bp, Artificial Sequence
  Description of Artificial Sequence: Synthetic Antisense oligonucleotide
  misc_feature (17)..(17): bicyclic nucleic acid (BNA)
gtaagttctgtccaagcc

SEQ ID NO: 11068 - DNA, 18 bp, Artificial Sequence
  Description of Artificial Sequence: Synthetic Antisense oligonucleotide
  misc_feature (12)..(12): bicyclic nucleic acid (BNA)
gtaagttctgtccaagcc

SEQ ID NO: 11069 - DNA, 18 bp, Artificial Sequence
  Description of Artificial Sequence: Synthetic Antisense oligonucleotide
  misc_feature (13)..(13): bicyclic nucleic acid (BNA)
gtaagttctgtccaagcc

SEQ ID NO: 11070 - DNA, 18 bp, Artificial Sequence
  Description of Artificial Sequence: Synthetic Antisense oligonucleotide
  misc_feature (8)..(8): bicyclic nucleic acid (BNA)
gtaagttctgtccaagcc

SEQ ID NO: 11071 - DNA, 18 bp, Artificial Sequence
  Description of Artificial Sequence: Synthetic Antisense oligonucleotide
  misc_feature (2)..(2): bicyclic nucleic acid (BNA)
agtcggtaagttctgtcc

SEQ ID NO: 11072 - DNA, 18 bp, Artificial Sequence
  Description of Artificial Sequence: Synthetic Antisense oligonucleotide
  misc_feature (4)..(4): bicyclic nucleic acid (BNA)
agtcggtaagttctgtcc

SEQ ID NO: 11073 - DNA, 18 bp, Artificial Sequence
  Description of Artificial Sequence: Synthetic Antisense oligonucleotide
  misc_feature (10)..(10): bicyclic nucleic acid (BNA)
agtcggtaagttctgtcc

SEQ ID NO: 11074 - DNA, 18 bp, Artificial Sequence
  Description of Artificial Sequence: Synthetic Antisense oligonucleotide
  misc_feature (5)..(5): bicyclic nucleic acid (BNA)
agtcggtaagttctgtcc

SEQ ID NO: 11075 - DNA, 18 bp, Artificial Sequence
  Description of Artificial Sequence: Synthetic Antisense oligonucleotide
  misc_feature (6)..(6): bicyclic nucleic acid (BNA)
agtcggtaagttctgtcc

SEQ ID NO: 11076 - DNA, 18 bp, Artificial Sequence
  Description of Artificial Sequence: Synthetic Antisense oligonucleotide
  misc_feature (17)..(17): bicyclic nucleic acid (BNA)
agtcggtaagttctgtcc

SEQ ID NO: 11077 - DNA, 18 bp, Artificial Sequence
  Description of Artificial Sequence: Synthetic Antisense oligonucleotide
  misc_feature (13)..(13): bicyclic nucleic acid (BNA)
agtcggtaagttctgtcc

SEQ ID NO: 11078 - DNA, 18 bp, Artificial Sequence
  Description of Artificial Sequence: Synthetic Antisense oligonucleotide
  misc_feature (15)..(15): bicyclic nucleic acid (BNA)
agtcggtaagttctgtcc

SEQ ID NO: 11079 - DNA, 18 bp, Artificial Sequence
  Description of Artificial Sequence: Synthetic Antisense oligonucleotide
  misc_feature (3)..(3): bicyclic nucleic acid (BNA)
ctgtccaagcccggttga

SEQ ID NO: 11080 - DNA, 18 bp, Artificial Sequence
  Description of Artificial Sequence: Synthetic Antisense oligonucleotide
  misc_feature (9)..(9): bicyclic nucleic acid (BNA)
ctgtccaagcccggttga

SEQ ID NO: 11081 - DNA, 18 bp, Artificial Sequence
  Description of Artificial Sequence: Synthetic Antisense oligonucleotide
  misc_feature (10)..(10): bicyclic nucleic acid (BNA)
ctgtccaagcccggttga

SEQ ID NO: 11082 - DNA, 18 bp, Artificial Sequence
  Description of Artificial Sequence: Synthetic Antisense oligonucleotide
  misc_feature (5)..(5): bicyclic nucleic acid (BNA)
ctgtccaagcccggttga

SEQ ID NO: 11083 - DNA, 18 bp, Artificial Sequence
  Description of Artificial Sequence: Synthetic Antisense oligonucleotide
  misc_feature (11)..(11): bicyclic nucleic acid (BNA)
ctgtccaagcccggttga

SEQ ID NO: 11084 - DNA, 18 bp, Artificial Sequence
  Description of Artificial Sequence: Synthetic Antisense oligonucleotide
  misc_feature (6)..(6): bicyclic nucleic acid (BNA)
ctgtccaagcccggttga

SEQ ID NO: 11085 - DNA, 18 bp, Artificial Sequence
  Description of Artificial Sequence: Synthetic Antisense oligonucleotide
  misc_feature (17)..(17): bicyclic nucleic acid (BNA)
ctgtccaagcccggttga

SEQ ID NO: 11086 - DNA, 18 bp, Artificial Sequence
  Description of Artificial Sequence: Synthetic Antisense oligonucleotide
  misc_feature (12)..(12): bicyclic nucleic acid (BNA)
ctgtccaagcccggttga

SEQ ID NO: 11087 - DNA, 18 bp, Artificial Sequence
  Description of Artificial Sequence: Synthetic Antisense oligonucleotide
  misc_feature (13)..(13): bicyclic nucleic acid (BNA)
ctgtccaagcccggttga

SEQ ID NO: 11088 - DNA, 18 bp, Artificial Sequence
  Description of Artificial Sequence: Synthetic Antisense oligonucleotide
  misc_feature (14)..(14): bicyclic nucleic acid (BNA)
ctgtccaagcccggttga

SEQ ID NO: 11089 - DNA, 18 bp, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
ggtaagttctgtccaagc

SEQ ID NO: 11090 - DNA, 18 bp, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
ggtaagttctgtccaagc

SEQ ID NO: 11091 - DNA, 18 bp, Artificial Sequence
  Description of Artificial Sequence: Synthetic Antisense oligonucleotide
  misc_feature (13)..(13): bicyclic nucleic acid (BNA)
  misc_feature (17)..(17): bicyclic nucleic acid (BNA)
ggtaagttctgtccaagc

SEQ ID NO: 11092 - DNA, 18 bp, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
ggtaagttctgtccaagc

SEQ ID NO: 11093 - DNA, 18 bp, Artificial Sequence
  Description of Artificial Sequence: Synthetic Antisense oligonucleotide
  misc_feature (13)..(14): bicyclic nucleic acid (BNA)
ggtaagttctgtccaagc

SEQ ID NO: 11094 - DNA, 18 bp, Artificial Sequence
  Description of Artificial Sequence: Synthetic Antisense oligonucleotide
  misc_feature (2)..(2): bicyclic nucleic acid (BNA)
  misc_feature (17)..(17): bicyclic nucleic acid (BNA)
ggtaagttctgtccaagc

SEQ ID NO: 11095 - DNA, 18 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
ggtaagttctgtccaagc

SEQ ID NO: 11096 - DNA, 18 bp, Artificial Sequence
  Description of Artificial Sequence: Synthetic Antisense oligonucleotide
  misc_feature (9)..(9): bicyclic nucleic acid (BNA)
  misc_feature (11)..(11): bicyclic nucleic acid (BNA)
ggtaagttctgtccaagc

SEQ ID NO: 11097 - DNA, 18 bp, Artificial Sequence
  Description of Artificial Sequence: Synthetic Antisense oligonucleotide
  misc_feature (14)..(14): bicyclic nucleic acid (BNA)
  misc_feature (17)..(17): bicyclic nucleic acid (BNA)
ggtaagttctgtccaagc

SEQ ID NO: 11098 - DNA, 18 bp, Artificial Sequence
  Description of Artificial Sequence: Synthetic Antisense oligonucleotide
  misc_feature (11)..(11): bicyclic nucleic acid (BNA)
  misc_feature (13)..(13): bicyclic nucleic acid (BNA)
ggtaagttctgtccaagc

SEQ ID NO: 11099 - DNA, 18 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
ggtaagttctgtccaagc

SEQ ID NO: 11100 - DNA, 18 bp, Artificial Sequence
  Description of Artificial Sequence: Synthetic Antisense oligonucleotide
  misc_feature (2)..(2): bicyclic nucleic acid (BNA)
  misc_feature (11)..(11): bicyclic nucleic acid (BNA)
ggtaagttctgtccaagc

SEQ ID NO: 11101 - DNA, 18 bp, Artificial Sequence
  Description of Artificial Sequence: Synthetic Antisense oligonucleotide
  misc_feature (9)..(9): bicyclic nucleic acid (BNA)
  misc_feature (17)..(17): bicyclic nucleic acid (BNA)
ggtaagttctgtccaagc

SEQ ID NO: 11102 - DNA, 18 bp, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
ggtaagttctgtccaagc

SEQ ID NO: 11103 - DNA, 18 bp, Artificial Sequence
  Description of Artificial Sequence: Synthetic Antisense oligonucleotide
  misc_feature (11)..(11): bicyclic nucleic acid (BNA)
  misc_feature (14)..(14): bicyclic nucleic acid (BNA)
ggtaagttctgtccaagc

SEQ ID NO: 11104 - DNA, 18 bp, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
ggtaagttctgtccaagc

SEQ ID NO: 11105 - DNA, 18 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
ggtaagttctgtccaagc

SEQ ID NO: 11106 - DNA, 18 bp, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
ggtaagttctgtccaagc

SEQ ID NO: 11107 - DNA, 18 bp, Artificial Sequence
  Description of Artificial Sequence: Synthetic Antisense oligonucleotide
  misc_feature (6)..(6): bicyclic nucleic acid (BNA)
  misc_feature (17)..(17): bicyclic nucleic acid (BNA)
ggtaagttctgtccaagc

SEQ ID NO: 11108 - DNA, 18 bp, Artificial Sequence
  Description of Artificial Sequence: Synthetic Antisense oligonucleotide
  misc_feature (11)..(11): bicyclic nucleic acid (BNA)
  misc_feature (17)..(17): bicyclic nucleic acid (BNA)
ggtaagttctgtccaagc

SEQ ID NO: 11109 - DNA, 18 bp, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
ggtaagttctgtccaagc

SEQ ID NO: 11110 - DNA, 18 bp, Artificial Sequence
  Description of Artificial Sequence: Synthetic Antisense oligonucleotide
  misc_feature (12)..(12): bicyclic nucleic acid (BNA)
  misc_feature (17)..(17): bicyclic nucleic acid (BNA)
gtaagttctgtccaagcc

SEQ ID NO: 11111 - DNA, 18 bp, Artificial Sequence
  Description of Artificial Sequence: Synthetic Antisense oligonucleotide
  misc_feature (5)..(5): bicyclic nucleic acid (BNA)
  misc_feature (8)..(8): bicyclic nucleic acid (BNA)
gtaagttctgtccaagcc

SEQ ID NO: 11112 - DNA, 18 bp, Artificial Sequence
  Description of Artificial Sequence: Synthetic Antisense oligonucleotide
  misc_feature (8)..(8): bicyclic nucleic acid (BNA)
  misc_feature (13)..(13): bicyclic nucleic acid (BNA)
gtaagttctgtccaagcc

SEQ ID NO: 11113 - DNA, 18 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
gtaagttctgtccaagcc

SEQ ID NO: 11114 - DNA, 18 bp, Artificial Sequence
  Description of Artificial Sequence: Synthetic Antisense oligonucleotide
  misc_feature (8)..(8): bicyclic nucleic acid (BNA)
  misc_feature (17)..(17): bicyclic nucleic acid (BNA)
gtaagttctgtccaagcc

SEQ ID NO: 11115 - DNA, 18 bp, Artificial Sequence
  Description of Artificial Sequence: Synthetic Antisense oligonucleotide
  misc_feature (13)..(13): bicyclic nucleic acid (BNA)
  misc_feature (17)..(17): bicyclic nucleic acid (BNA)
gtaagttctgtccaagcc

SEQ ID NO: 11116 - DNA, 18 bp, Artificial Sequence
  Description of Artificial Sequence: Synthetic Antisense oligonucleotide
  misc_feature (8)..(8): bicyclic nucleic acid (BNA)
  misc_feature (12)..(12): bicyclic nucleic acid (BNA)
gtaagttctgtccaagcc

SEQ ID NO: 11117 - DNA, 18 bp, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
gtaagttctgtccaagcc

SEQ ID NO: 11118 - DNA, 18 bp, Artificial Sequence
  Description of Artificial Sequence: Synthetic Antisense oligonucleotide
  misc_feature (8)..(8): bicyclic nucleic acid (BNA)
  misc_feature (16)..(16): bicyclic nucleic acid (BNA)
gtaagttctgtccaagcc

SEQ ID NO: 11119 - DNA, 18 bp, Artificial Sequence
  Description of Artificial Sequence: Synthetic Antisense oligonucleotide
  misc_feature (10)..(10): bicyclic nucleic acid (BNA)
  misc_feature (16)..(16): bicyclic nucleic acid (BNA)
gtaagttctgtccaagcc

SEQ ID NO: 11120 - DNA, 18 bp, Artificial Sequence
  Description of Artificial Sequence: Synthetic Antisense oligonucleotide
  misc_feature (10)..(10): bicyclic nucleic acid (BNA)
  misc_feature (12)..(12): bicyclic nucleic acid (BNA)
gtaagttctgtccaagcc

SEQ ID NO: 11121 - DNA, 18 bp, Artificial Sequence
  Description of Artificial Sequence: Synthetic Antisense oligonucleotide
  misc_feature (5)..(5): bicyclic nucleic acid (BNA)
  misc_feature (17)..(17): bicyclic nucleic acid (BNA)
gtaagttctgtccaagcc

SEQ ID NO: 11122 - DNA, 18 bp, Artificial Sequence
  Description of Artificial Sequence: Synthetic Antisense oligonucleotide
  misc_feature (10)..(10): bicyclic nucleic acid (BNA)
  misc_feature (17)..(17): bicyclic nucleic acid (BNA)
gtaagttctgtccaagcc

SEQ ID NO: 11123 - DNA, 18 bp, Artificial Sequence
  Description of Artificial Sequence: Synthetic Antisense oligonucleotide
  misc_feature (12)..(13): bicyclic nucleic acid (BNA)
gtaagttctgtccaagcc

SEQ ID NO: 11124 - DNA, 18 bp, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
gtaagttctgtccaagcc

SEQ ID NO: 11125 - DNA, 18 bp, Artificial Sequence
  Description of Artificial Sequence: Synthetic Antisense oligonucleotide
  misc_feature (8)..(8): bicyclic nucleic acid (BNA)
  misc_feature (10)..(10): bicyclic nucleic acid (BNA)
gtaagttctgtccaagcc

SEQ ID NO: 11126 - DNA, 18 bp, Artificial Sequence
  Description of Artificial Sequence: Synthetic Antisense oligonucleotide
  misc_feature (13)..(13): bicyclic nucleic acid (BNA)
  misc_feature (16)..(16): bicyclic nucleic acid (BNA)
gtaagttctgtccaagcc

SEQ ID NO: 11127 - DNA, 18 bp, Artificial Sequence
  Description of Artificial Sequence: Synthetic Antisense oligonucleotide
  misc_feature (5)..(5): bicyclic nucleic acid (BNA)
  misc_feature (16)..(16): bicyclic nucleic acid (BNA)
gtaagttctgtccaagcc

SEQ ID NO: 11128 - DNA, 18 bp, Artificial Sequence
  Description of Artificial Sequence: Synthetic Antisense oligonucleotide
  misc_feature (12)..(12): bicyclic nucleic acid (BNA)
  misc_feature (16)..(16): bicyclic nucleic acid (BNA)
gtaagttctgtccaagcc

SEQ ID NO: 11129 - DNA, 18 bp, Artificial Sequence
  Description of Artificial Sequence: Synthetic Antisense oligonucleotide
  misc_feature (16)..(17): bicyclic nucleic acid (BNA)
gtaagttctgtccaagcc

SEQ ID NO: 11130 - DNA, 18 bp, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
gtaagttctgtccaagcc

SEQ ID NO: 11131 - DNA, 18 bp, Artificial Sequence
  Description of Artificial Sequence: Synthetic Antisense oligonucleotide
  misc_feature (6)..(6): bicyclic nucleic acid (BNA)
  misc_feature (10)..(10): bicyclic nucleic acid (BNA)
agtcggtaagttctgtcc

SEQ ID NO: 11132 - DNA, 18 bp, Artificial Sequence
  Description of Artificial Sequence: Synthetic Antisense oligonucleotide
  misc_feature (2)..(2): bicyclic nucleic acid (BNA)
  misc_feature (4)..(4): bicyclic nucleic acid (BNA)
agtcggtaagttctgtcc

SEQ ID NO: 11133 - DNA, 18 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
agtcggtaagttctgtcc

SEQ ID NO: 11134 - DNA, 18 bp, Artificial Sequence
  Description of Artificial Sequence: Synthetic Antisense oligonucleotide
  misc_feature (13)..(13): bicyclic nucleic acid (BNA)
  misc_feature (17)..(17): bicyclic nucleic acid (BNA)
agtcggtaagttctgtcc

SEQ ID NO: 11135 - DNA, 18 bp, Artificial Sequence
  Description of Artificial Sequence: Synthetic Antisense oligonucleotide
  misc_feature (4)..(4): bicyclic nucleic acid (BNA)
  misc_feature (15)..(15): bicyclic nucleic acid (BNA)
agtcggtaagttctgtcc

SEQ ID NO: 11136 - DNA, 18 bp, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
agtcggtaagttctgtcc

SEQ ID NO: 11137 - DNA, 18 bp, Artificial Sequence
  Description of Artificial Sequence: Synthetic Antisense oligonucleotide
  misc_feature (2)..(2): bicyclic nucleic acid (BNA)
  misc_feature (17)..(17): bicyclic nucleic acid (BNA)
agtcggtaagttctgtcc

SEQ ID NO: 11138 - DNA, 18 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
agtcggtaagttctgtcc

SEQ ID NO: 11139 - DNA, 18 bp, Artificial Sequence
  Description of Artificial Sequence: Synthetic Antisense oligonucleotide
  misc_feature (2)..(2): bicyclic nucleic acid (BNA)
  misc_feature (15)..(15): bicyclic nucleic acid (BNA)
agtcggtaagttctgtcc

SEQ ID NO: 11140 - DNA, 18 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
agtcggtaagttctgtcc

SEQ ID NO: 11141 - DNA, 18 bp, Artificial Sequence
  Description of Artificial Sequence: Synthetic Antisense oligonucleotide
  misc_feature (4)..(4): bicyclic nucleic acid (BNA)
  misc_feature (17)..(17): bicyclic nucleic acid (BNA)
agtcggtaagttctgtcc

SEQ ID NO: 11142 - DNA, 18 bp, Artificial Sequence
  Description of Artificial Sequence: Synthetic Antisense oligonucleotide
  misc_feature (10)..(10): bicyclic nucleic acid (BNA)
  misc_feature (15)..(15): bicyclic nucleic acid (BNA)
agtcggtaagttctgtcc

SEQ ID NO: 11143 - DNA, 18 bp, Artificial Sequence
  Description of Artificial Sequence: Synthetic Antisense oligonucleotide
  misc_feature (13)..(13): bicyclic nucleic acid (BNA)
  misc_feature (15)..(15): bicyclic nucleic acid (BNA)
agtcggtaagttctgtcc

SEQ ID NO: 11144 - DNA, 18 bp, Artificial Sequence
  Description of Artificial Sequence: Synthetic Antisense oligonucleotide
  misc_feature (5)..(6): bicyclic nucleic acid (BNA)
agtcggtaagttctgtcc

SEQ ID NO: 11145 - DNA, 18 bp, Artificial Sequence
  Description of Artificial Sequence: Synthetic Antisense oligonucleotide
  misc_feature (5)..(5): bicyclic nucleic acid (BNA)
  misc_feature (15)..(15): bicyclic nucleic acid (BNA)
agtcggtaagttctgtcc

SEQ ID NO: 11146 - DNA, 18 bp, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
agtcggtaagttctgtcc

SEQ ID NO: 11147 - DNA, 18 bp, Artificial Sequence
  Description of Artificial Sequence: Synthetic Antisense oligonucleotide
  misc_feature (5)..(5): bicyclic nucleic acid (BNA)
  misc_feature (17)..(17): bicyclic nucleic acid (BNA)
agtcggtaagttctgtcc

SEQ ID NO: 11148 - DNA, 18 bp, Artificial Sequence
  Description of Artificial Sequence: Synthetic Antisense oligonucleotide
  misc_feature (10)..(10): bicyclic nucleic acid (BNA)
  misc_feature (17)..(17): bicyclic nucleic acid (BNA)
agtcggtaagttctgtcc

SEQ ID NO: 11149 - DNA, 18 bp, Artificial Sequence
  Description of Artificial Sequence: Synthetic Antisense oligonucleotide
  misc_feature (4)..(4): bicyclic nucleic acid (BNA)
  misc_feature (10)..(10): bicyclic nucleic acid (BNA)
agtcggtaagttctgtcc

SEQ ID NO: 11150 - DNA, 18 bp, Artificial Sequence
  Description of Artificial Sequence: Synthetic Antisense oligonucleotide
  misc_feature (2)..(2): bicyclic nucleic acid (BNA)
  misc_feature (10)..(10): bicyclic nucleic acid (BNA)
agtcggtaagttctgtcc

SEQ ID NO: 11151 - DNA, 18 bp, Artificial Sequence
  Description of Artificial Sequence: Synthetic Antisense oligonucleotide
  misc_feature (4)..(4): bicyclic nucleic acid (BNA)
  misc_feature (6)..(6): bicyclic nucleic acid (BNA)
agtcggtaagttctgtcc

SEQ ID NO: 11152 - DNA, 18 bp, Artificial Sequence
  Description of Artificial Sequence: Synthetic Antisense oligonucleotide
  misc_feature (4)..(4): bicyclic nucleic acid (BNA)
  misc_feature (13)..(13): bicyclic nucleic acid (BNA)
agtcggtaagttctgtcc

SEQ ID NO: 11153 - DNA, 18 bp, Artificial Sequence
  Description of Artificial Sequence: Synthetic Antisense oligonucleotide
  misc_feature (15)..(15): bicyclic nucleic acid (BNA)
  misc_feature (17)..(17): bicyclic nucleic acid (BNA)
agtcggtaagttctgtcc

SEQ ID NO: 11154 - DNA, 18 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
agtcggtaagttctgtcc

SEQ ID NO: 11155 - DNA, 18 bp, Artificial Sequence
  Description of Artificial Sequence: Synthetic Antisense oligonucleotide
  misc_feature (6)..(6): bicyclic nucleic acid (BNA)
  misc_feature (17)..(17): bicyclic nucleic acid (BNA)
agtcggtaagttctgtcc

SEQ ID NO: 11156 - DNA, 18 bp, Artificial Sequence
  Description of Artificial Sequence: Synthetic Antisense oligonucleotide
  misc_feature (6)..(6): bicyclic nucleic acid (BNA)
  misc_feature (15)..(15): bicyclic nucleic acid (BNA)
agtcggtaagttctgtcc

SEQ ID NO: 11157 - DNA, 18 bp, Artificial Sequence
  Description of Artificial Sequence: Synthetic Antisense oligonucleotide
  misc_feature (4)..(5): bicyclic nucleic acid (BNA)
agtcggtaagttctgtcc

SEQ ID NO: 11158 - DNA, 18 bp, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
agtcggtaagttctgtcc

SEQ ID NO: 11159 - DNA, 18 bp, Artificial Sequence
  Description of Artificial Sequence: Synthetic Antisense oligonucleotide
  misc_feature (12)..(12): bicyclic nucleic acid (BNA)
  misc_feature (17)..(17): bicyclic nucleic acid (BNA)
ctgtccaagcccggttga

SEQ ID NO: 11160 - DNA, 18 bp, Artificial Sequence
  Description of Artificial Sequence: Synthetic Antisense oligonucleotide
  misc_feature (6)..(6): bicyclic nucleic acid (BNA)
  misc_feature (10)..(10): bicyclic nucleic acid (BNA)
ctgtccaagcccggttga

SEQ ID NO: 11161 - DNA, 18 bp, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
ctgtccaagcccggttga

SEQ ID NO: 11162 - DNA, 18 bp, Artificial Sequence
  Description of Artificial Sequence: Synthetic Antisense oligonucleotide
  misc_feature (11)..(12): bicyclic nucleic acid (BNA)
ctgtccaagcccggttga

SEQ ID NO: 11163 - DNA, 18 bp, Artificial Sequence
  Description of Artificial Sequence: Synthetic Antisense oligonucleotide
  misc_feature (5)..(5): bicyclic nucleic acid (BNA)
  misc_feature (9)..(9): bicyclic nucleic acid (BNA)
ctgtccaagcccggttga

SEQ ID NO: 11164 - DNA, 18 bp, Artificial Sequence
  Description of Artificial Sequence: Synthetic Antisense oligonucleotide
  misc_feature (3)..(3): bicyclic nucleic acid (BNA)
  misc_feature (9)..(9): bicyclic nucleic acid (BNA)
ctgtccaagcccggttga

SEQ ID NO: 11165 - DNA, 18 bp, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
ctgtccaagcccggttga

SEQ ID NO: 11166 - DNA, 18 bp, Artificial Sequence
  Description of Artificial Sequence: Synthetic Antisense oligonucleotide
  misc_feature (9)..(10): bicyclic nucleic acid (BNA)
ctgtccaagcccggttga

SEQ ID NO: 11167 - DNA, 18 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
ctgtccaagcccggttga

SEQ ID NO: 11168 - DNA, 18 bp, Artificial Sequence
  Description of Artificial Sequence: Synthetic Antisense oligonucleotide
  misc_feature (3)..(3): bicyclic nucleic acid (BNA)
  misc_feature (13)..(13): bicyclic nucleic acid (BNA)
ctgtccaagcccggttga

SEQ ID NO: 11169 - DNA, 18 bp, Artificial Sequence
  Description of Artificial Sequence: Synthetic Antisense oligonucleotide
  misc_feature (13)..(13): bicyclic nucleic acid (BNA)
  misc_feature (17)..(17): bicyclic nucleic acid (BNA)
ctgtccaagcccggttga

SEQ ID NO: 11170 - DNA, 18 bp, Artificial Sequence
  Description of Artificial Sequence: Synthetic Antisense oligonucleotide
  misc_feature (3)..(3): bicyclic nucleic acid (BNA)
  misc_feature (6)..(6): bicyclic nucleic acid (BNA)
ctgtccaagcccggttga

SEQ ID NO: 11171 - DNA, 18 bp, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
ctgtccaagcccggttga

SEQ ID NO: 11172 - DNA, 18 bp, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
ctgtccaagcccggttga

SEQ ID NO: 11173 - DNA, 18 bp, Artificial Sequence
  Description of Artificial Sequence: Synthetic Antisense oligonucleotide
  misc_feature (3)..(3): bicyclic nucleic acid (BNA)
  misc_feature (10)..(10): bicyclic nucleic acid (BNA)
ctgtccaagcccggttga

SEQ ID NO: 11174 - DNA, 18 bp, Artificial Sequence
  Description of Artificial Sequence: Synthetic Antisense oligonucleotide
  misc_feature (13)..(14): bicyclic nucleic acid (BNA)
ctgtccaagcccggttga

SEQ ID NO: 11175 - DNA, 18 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
ctgtccaagcccggttga

SEQ ID NO: 11176 - DNA, 18 bp, Artificial Sequence
  Description of Artificial Sequence: Synthetic Antisense oligonucleotide
  misc_feature (9)..(9): bicyclic nucleic acid (BNA)
  misc_feature (11)..(11): bicyclic nucleic acid (BNA)
ctgtccaagcccggttga

SEQ ID NO: 11177 - DNA, 18 bp, Artificial Sequence
  Description of Artificial Sequence: Synthetic Antisense oligonucleotide
  misc_feature (14)..(14): bicyclic nucleic acid (BNA)
  misc_feature (17)..(17): bicyclic nucleic acid (BNA)
ctgtccaagcccggttga

SEQ ID NO: 11178 - DNA, 18 bp, Artificial Sequence
  Description of Artificial Sequence: Synthetic Antisense oligonucleotide
  misc_feature (11)..(11): bicyclic nucleic acid (BNA)
  misc_feature (13)..(13): bicyclic nucleic acid (BNA)
ctgtccaagcccggttga

SEQ ID NO: 11179 - DNA, 18 bp, Artificial Sequence
  Description of Artificial Sequence: Synthetic Antisense oligonucleotide
  misc_feature (5)..(5): bicyclic nucleic acid (BNA)
  misc_feature (14)..(14): bicyclic nucleic acid (BNA)
ctgtccaagcccggttga

SEQ ID NO: 11180 - DNA, 18 bp, Artificial Sequence
  Description of Artificial Sequence: Synthetic Antisense oligonucleotide
  misc_feature (3)..(3): bicyclic nucleic acid (BNA)
  misc_feature (14)..(14): bicyclic nucleic acid (BNA)
ctgtccaagcccggttga

SEQ ID NO: 11181 - DNA, 18 bp, Artificial Sequence
  Description of Artificial Sequence: Synthetic Antisense oligonucleotide
  misc_feature (10)..(10): bicyclic nucleic acid (BNA)
  misc_feature (12)..(12): bicyclic nucleic acid (BNA)
ctgtccaagcccggttga

SEQ ID NO: 11182 - DNA, 18 bp, Artificial Sequence
  Description of Artificial Sequence: Synthetic Antisense oligonucleotide
  misc_feature (9)..(9): bicyclic nucleic acid (BNA)
  misc_feature (17)..(17): bicyclic nucleic acid (BNA)
ctgtccaagcccggttga

SEQ ID NO: 11183 - DNA, 18 bp, Artificial Sequence
  Description of Artificial Sequence: Synthetic Antisense oligonucleotide
  misc_feature (12)..(12): bicyclic nucleic acid (BNA)
  misc_feature (14)..(14): bicyclic nucleic acid (BNA)
ctgtccaagcccggttga

SEQ ID NO: 11184 - DNA, 18 bp, Artificial Sequence
  Description of Artificial Sequence: Synthetic Antisense oligonucleotide
  misc_feature (5)..(5): bicyclic nucleic acid (BNA)
  misc_feature (11)..(11): bicyclic nucleic acid (BNA)
ctgtccaagcccggttga

SEQ ID NO: 11185 - DNA, 18 bp, Artificial Sequence
  Description of Artificial Sequence: Synthetic Antisense oligonucleotide
  misc_feature (3)..(3): bicyclic nucleic acid (BNA)
  misc_feature (17)..(17): bicyclic nucleic acid (BNA)
ctgtccaagcccggttga

SEQ ID NO: 11186 - DNA, 18 bp, Artificial Sequence
  Description of Artificial Sequence: Synthetic Antisense oligonucleotide
  misc_feature (6)..(6): bicyclic nucleic acid (BNA)
  misc_feature (12)..(12): bicyclic nucleic acid (BNA)
ctgtccaagcccggttga

SEQ ID NO: 11187 - DNA, 18 bp, Artificial Sequence
  Description of Artificial Sequence: Synthetic Antisense oligonucleotide
  misc_feature (5)..(6): bicyclic nucleic acid (BNA)
ctgtccaagcccggttga

SEQ ID NO: 11188 - DNA, 18 bp, Artificial Sequence
  Description of Artificial Sequence: Synthetic Antisense oligonucleotide
  misc_feature (11)..(11): bicyclic nucleic acid (BNA)
  misc_feature (14)..(14): bicyclic nucleic acid (BNA)
ctgtccaagcccggttga

SEQ ID NO: 11189 - DNA, 18 bp, Artificial Sequence
  Description of Artificial Sequence: Synthetic Antisense oligonucleotide
  misc_feature (9)..(9): bicyclic nucleic acid (BNA)
  misc_feature (12)..(12): bicyclic nucleic acid (BNA)
ctgtccaagcccggttga

SEQ ID NO: 11190 - DNA, 18 bp, Artificial Sequence
  Description of Artificial Sequence: Synthetic Antisense oligonucleotide
  misc_feature (5)..(5): bicyclic nucleic acid (BNA)
  misc_feature (17)..(17): bicyclic nucleic acid (BNA)
ctgtccaagcccggttga

SEQ ID NO: 11191 - DNA, 18 bp, Artificial Sequence
  Description of Artificial Sequence: Synthetic Antisense oligonucleotide
  misc_feature (3)..(3): bicyclic nucleic acid (BNA)
  misc_feature (11)..(11): bicyclic nucleic acid (BNA)
ctgtccaagcccggttga

SEQ ID NO: 11192 - DNA, 18 bp, Artificial Sequence
  Description of Artificial Sequence: Synthetic Antisense oligonucleotide
  misc_feature (10)..(11): bicyclic nucleic acid (BNA)
ctgtccaagcccggttga

SEQ ID NO: 11193 - DNA, 18 bp, Artificial Sequence
  Description of Artificial Sequence: Synthetic Antisense oligonucleotide
  misc_feature (10)..(10): bicyclic nucleic acid (BNA)
  misc_feature (17)..(17): bicyclic nucleic acid (BNA)
ctgtccaagcccggttga

SEQ ID NO: 11194 - DNA, 18 bp, Artificial Sequence
  Description of Artificial Sequence: Synthetic Antisense oligonucleotide
  misc_feature (12)..(13): bicyclic nucleic acid (BNA)
ctgtccaagcccggttga

SEQ ID NO: 11195 - DNA, 18 bp, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
ctgtccaagcccggttga

SEQ ID NO: 11196 - DNA, 18 bp, Artificial Sequence
  Description of Artificial Sequence: Synthetic Antisense oligonucleotide
  misc_feature (10)..(10): bicyclic nucleic acid (BNA)
  misc_feature (14)..(14): bicyclic nucleic acid (BNA)
ctgtccaagcccggttga

SEQ ID NO: 11197 - DNA, 18 bp, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
ctgtccaagcccggttga

SEQ ID NO: 11198 - DNA, 18 bp, Artificial Sequence
  Description of Artificial Sequence: Synthetic Antisense oligonucleotide
  misc_feature (6)..(6): bicyclic nucleic acid (BNA)
  misc_feature (17)..(17): bicyclic nucleic acid (BNA)
ctgtccaagcccggttga

SEQ ID NO: 11199 - DNA, 18 bp, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
ctgtccaagcccggttga

SEQ ID NO: 11200 - DNA, 18 bp, Artificial Sequence
  Description of Artificial Sequence: Synthetic Antisense oligonucleotide
  misc_feature (11)..(11): bicyclic nucleic acid (BNA)
  misc_feature (17)..(17): bicyclic nucleic acid (BNA)
ctgtccaagcccggttga

SEQ ID NO: 11201 - DNA, 18 bp, Artificial Sequence
  Description of Artificial Sequence: Synthetic Antisense oligonucleotide
  misc_feature (3)..(3): bicyclic nucleic acid (BNA)
  misc_feature (12)..(12): bicyclic nucleic acid (BNA)
ctgtccaagcccggttga

SEQ ID NO: 11202 - DNA, 18 bp, Artificial Sequence
  Description of Artificial Sequence: Synthetic Antisense oligonucleotide
  misc_feature (3)..(3): bicyclic nucleic acid (BNA)
  misc_feature (5)..(5): bicyclic nucleic acid (BNA)
ctgtccaagcccggttga

SEQ ID NO: 11203 - DNA, 18 bp, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
ctgtccaagcccggttga

SEQ ID NO: 11204 - DNA, 20 bp, Artificial Sequence
  Description of Artificial Sequence: Synthetic Antisense oligonucleotide
  misc_feature (2)..(2): bicyclic nucleic acid (BNA)
tcaaggaagatggcatttct

SEQ ID NO: 11205 - DNA, 20 bp, Artificial Sequence
  Description of Artificial Sequence: Synthetic Antisense oligonucleotide
  misc_feature (9)..(9): bicyclic nucleic acid (BNA)
tcaaggaagatggcatttct

SEQ ID NO: 11206 - DNA, 20 bp, Artificial Sequence
  Description of Artificial Sequence: Synthetic Antisense oligonucleotide
  misc_feature (5)..(5): bicyclic nucleic acid (BNA)
tcaaggaagatggcatttct

SEQ ID NO: 11207 - DNA, 20 bp, Artificial Sequence
  Description of Artificial Sequence: Synthetic Antisense oligonucleotide
  misc_feature (6)..(6): bicyclic nucleic acid (BNA)
tcaaggaagatggcatttct

SEQ ID NO: 11208 - DNA, 20 bp, Artificial Sequence
  Description of Artificial Sequence: Synthetic Antisense oligonucleotide
  misc_feature (12)..(12): bicyclic nucleic acid (BNA)
tcaaggaagatggcatttct

SEQ ID NO: 11209 - DNA, 20 bp, Artificial Sequence
  Description of Artificial Sequence: Synthetic Antisense oligonucleotide
  misc_feature (13)..(13): bicyclic nucleic acid (BNA)
tcaaggaagatggcatttct

SEQ ID NO: 11210 - DNA, 20 bp, Artificial Sequence
  Description of Artificial Sequence: Synthetic Antisense oligonucleotide
  misc_feature (19)..(19): bicyclic nucleic acid (BNA)
tcaaggaagatggcatttct

SEQ ID NO: 11211 - DNA, 20 bp, Artificial Sequence
  Description of Artificial Sequence: Synthetic Antisense oligonucleotide
  misc_feature (14)..(14): bicyclic nucleic acid (BNA)
tcaaggaagatggcatttct

SEQ ID NO: 11212 - DNA, 22 bp, Artificial Sequence
  Description of Artificial Sequence: Synthetic Antisense oligonucleotide
  misc_feature (2)..(2): bicyclic nucleic acid (BNA)
tcaaggaagatggcatttctag

SEQ ID NO: 11213 - DNA, 22 bp, Artificial Sequence
  Description of Artificial Sequence: Synthetic Antisense oligonucleotide
  misc_feature (9)..(9): bicyclic nucleic acid (BNA)
tcaaggaagatggcatttctag

SEQ ID NO: 11214 - DNA, 22 bp, Artificial Sequence
  Description of Artificial Sequence: Synthetic Antisense oligonucleotide
  misc_feature (5)..(5): bicyclic nucleic acid (BNA)
tcaaggaagatggcatttctag

SEQ ID NO: 11215 - DNA, 22 bp, Artificial Sequence
  Description of Artificial Sequence: Synthetic Antisense oligonucleotide
  misc_feature (6)..(6): bicyclic nucleic acid (BNA)
tcaaggaagatggcatttctag

SEQ ID NO: 11216 - DNA, 22 bp, Artificial Sequence
  Description of Artificial Sequence: Synthetic Antisense oligonucleotide
  misc_feature (12)..(12): bicyclic nucleic acid (BNA)
tcaaggaagatggcatttctag

SEQ ID NO: 11217 - DNA, 22 bp, Artificial Sequence
  Description of Artificial Sequence: Synthetic Antisense oligonucleotide
  misc_feature (13)..(13): bicyclic nucleic acid (BNA)
tcaaggaagatggcatttctag

SEQ ID NO: 11218 - DNA, 22 bp, Artificial Sequence
  Description of Artificial Sequence: Synthetic Antisense oligonucleotide
  misc_feature (19)..(19): bicyclic nucleic acid (BNA)
tcaaggaagatggcatttctag

SEQ ID NO: 11219 - DNA, 22 bp, Artificial Sequence
  Description of Artificial Sequence: Synthetic Antisense oligonucleotide
  misc_feature (14)..(14): bicyclic nucleic acid (BNA)
tcaaggaagatggcatttctag

SEQ ID NO: 11220 - DNA, 20 bp, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
tcaaggaagatggcatttct

SEQ ID NO: 11221 - DNA, 20 bp, Artificial Sequence
  Description of Artificial Sequence: Synthetic Antisense oligonucleotide
  misc_feature (5)..(5): bicyclic nucleic acid (BNA)
  misc_feature (9)..(9): bicyclic nucleic acid (BNA)
tcaaggaagatggcatttct

SEQ ID NO: 11222 - DNA, 20 bp, Artificial Sequence
  Description of Artificial Sequence: Synthetic Antisense oligonucleotide
  misc_feature (5)..(5): bicyclic nucleic acid (BNA)
  misc_feature (19)..(19): bicyclic nucleic acid (BNA)
tcaaggaagatggcatttct

SEQ ID NO: 11223 - DNA, 20 bp, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
tcaaggaagatggcatttct

SEQ ID NO: 11224 - DNA, 20 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
tcaaggaagatggcatttct

SEQ ID NO: 11225 - DNA, 20 bp, Artificial Sequence
  Description of Artificial Sequence: Synthetic Antisense oligonucleotide
  misc_feature (2)..(2): bicyclic nucleic acid (BNA)
  misc_feature (12)..(12): bicyclic nucleic acid (BNA)
tcaaggaagatggcatttct

SEQ ID NO: 11226 - DNA, 20 bp, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
tcaaggaagatggcatttct

SEQ ID NO: 11227 - DNA, 20 bp, Artificial Sequence
  Description of Artificial Sequence: Synthetic Antisense oligonucleotide
  misc_feature (13)..(14): bicyclic nucleic acid (BNA)
tcaaggaagatggcatttct

SEQ ID NO: 11228 - DNA, 20 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
tcaaggaagatggcatttct

SEQ ID NO: 11229 - DNA, 20 bp, Artificial Sequence
  Description of Artificial Sequence: Synthetic Antisense oligonucleotide
  misc_feature (6)..(6): bicyclic nucleic acid (BNA)
  misc_feature (19)..(19): bicyclic nucleic acid (BNA)
tcaaggaagatggcatttct

SEQ ID NO: 11230 - DNA, 20 bp, Artificial Sequence
  Description of Artificial Sequence: Synthetic Antisense oligonucleotide
  misc_feature (5)..(5): bicyclic nucleic acid (BNA)
  misc_feature (14)..(14): bicyclic nucleic acid (BNA)
tcaaggaagatggcatttct

SEQ ID NO: 11231 - DNA, 20 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
tcaaggaagatggcatttct

SEQ ID NO: 11232 - DNA, 20 bp, Artificial Sequence
  Description of Artificial Sequence: Synthetic Antisense oligonucleotide
  misc_feature (12)..(12): bicyclic nucleic acid (BNA)
  misc_feature (19)..(19): bicyclic nucleic acid (BNA)
tcaaggaagatggcatttct

SEQ ID NO: 11233 - DNA, 20 bp, Artificial Sequence
  Description of Artificial Sequence: Synthetic Antisense oligonucleotide
  misc_feature (12)..(12): bicyclic nucleic acid (BNA)
  misc_feature (14)..(14): bicyclic nucleic acid (BNA)
tcaaggaagatggcatttct

SEQ ID NO: 11234 - DNA, 20 bp, Artificial Sequence
  Description of Artificial Sequence: Synthetic Antisense oligonucleotide
  misc_feature (6)..(6): bicyclic nucleic acid (BNA)
  misc_feature (12)..(12): bicyclic nucleic acid (BNA)
tcaaggaagatggcatttct

SEQ ID NO: 11235 - DNA, 20 bp, Artificial Sequence
  Description of Artificial Sequence: Synthetic Antisense oligonucleotide
  misc_feature (5)..(6): bicyclic nucleic acid (BNA)
tcaaggaagatggcatttct

SEQ ID NO: 11236 - DNA, 20 bp, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
tcaaggaagatggcatttct

SEQ ID NO: 11237 - DNA, 20 bp, Artificial Sequence
  Description of Artificial Sequence: Synthetic Antisense oligonucleotide
  misc_feature (9)..(9): bicyclic nucleic acid (BNA)
  misc_feature (12)..(12): bicyclic nucleic acid (BNA)
tcaaggaagatggcatttct

SEQ ID NO: 11238 - DNA, 20 bp, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
tcaaggaagatggcatttct

SEQ ID NO: 11239 - DNA, 20 bp, Artificial Sequence
  Description of Artificial Sequence: Synthetic Antisense oligonucleotide
  misc_feature (13)..(13): bicyclic nucleic acid (BNA)
  misc_feature (19)..(19): bicyclic nucleic acid (BNA)
tcaaggaagatggcatttct

SEQ ID NO: 11240 - DNA, 20 bp, Artificial Sequence
  Description of Artificial Sequence: Synthetic Antisense oligonucleotide
  misc_feature (12)..(13): bicyclic nucleic acid (BNA)
tcaaggaagatggcatttct

SEQ ID NO: 11241 - DNA, 20 bp, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
tcaaggaagatggcatttct

SEQ ID NO: 11242 - DNA, 20 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
tcaaggaagatggcatttct

SEQ ID NO: 11243 - DNA, 20 bp, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
tcaaggaagatggcatttct

SEQ ID NO: 11244 - DNA, 20 bp, Artificial Sequence
  Description of Artificial Sequence: Synthetic Antisense oligonucleotide
  misc_feature (2)..(2): bicyclic nucleic acid (BNA)
  misc_feature (19)..(19): bicyclic nucleic acid (BNA)
tcaaggaagatggcatttct

SEQ ID NO: 11245 - DNA, 20 bp, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
tcaaggaagatggcatttct

SEQ ID NO: 11246 - DNA, 20 bp, Artificial Sequence
  Description of Artificial Sequence: Synthetic Antisense oligonucleotide
  misc_feature (14)..(14): bicyclic nucleic acid (BNA)
  misc_feature (19)..(19): bicyclic nucleic acid (BNA)
tcaaggaagatggcatttct

SEQ ID NO: 11247 - DNA, 20 bp, Artificial Sequence
  Description of Artificial Sequence: Synthetic Antisense oligonucleotide
  misc_feature (9)..(9): bicyclic nucleic acid (BNA)
  misc_feature (19)..(19): bicyclic nucleic acid (BNA)
tcaaggaagatggcatttct

SEQ ID NO: 11248 - DNA, 22 bp, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
tcaaggaagatggcatttctag

SEQ ID NO: 11249 - DNA, 22 bp, Artificial Sequence
  Description of Artificial Sequence: Synthetic Antisense oligonucleotide
  misc_feature (5)..(5): bicyclic nucleic acid (BNA)
  misc_feature (9)..(9): bicyclic nucleic acid (BNA)
tcaaggaagatggcatttctag

SEQ ID NO: 11250 - DNA, 22 bp, Artificial Sequence
  Description of Artificial Sequence: Synthetic Antisense oligonucleotide
  misc_feature (5)..(5): bicyclic nucleic acid (BNA)
  misc_feature (19)..(19): bicyclic nucleic acid (BNA)
tcaaggaagatggcatttctag

SEQ ID NO: 11251 - DNA, 22 bp, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
tcaaggaagatggcatttctag

SEQ ID NO: 11252 - DNA, 22 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
tcaaggaagatggcatttctag

SEQ ID NO: 11253 - DNA, 22 bp, Artificial Sequence
  Description of Artificial Sequence: Synthetic Antisense oligonucleotide
  misc_feature (2)..(2): bicyclic nucleic acid (BNA)
  misc_feature (12)..(12): bicyclic nucleic acid (BNA)
tcaaggaagatggcatttctag

SEQ ID NO: 11254 - DNA, 22 bp, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
tcaaggaagatggcatttctag

SEQ ID NO: 11255 - DNA, 22 bp, Artificial Sequence
  Description of Artificial Sequence: Synthetic Antisense oligonucleotide
  misc_feature (13)..(14): bicyclic nucleic acid (BNA)
tcaaggaagatggcatttctag

SEQ ID NO: 11256 - DNA, 22 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
tcaaggaagatggcatttctag

SEQ ID NO: 11257 - DNA, 22 bp, Artificial Sequence
  Description of Artificial Sequence: Synthetic Antisense oligonucleotide
  misc_feature (6)..(6): bicyclic nucleic acid (BNA)
  misc_feature (19)..(19): bicyclic nucleic acid (BNA)
tcaaggaagatggcatttctag

SEQ ID NO: 11258 - DNA, 22 bp, Artificial Sequence
  Description of Artificial Sequence: Synthetic Antisense oligonucleotide
  misc_feature (5)..(5): bicyclic nucleic acid (BNA)
  misc_feature (14)..(14): bicyclic nucleic acid (BNA)
tcaaggaagatggcatttctag

SEQ ID NO: 11259 - DNA, 22 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
tcaaggaagatggcatttctag

SEQ ID NO: 11260 - DNA, 22 bp, Artificial Sequence
  Description of Artificial Sequence: Synthetic Antisense oligonucleotide
  misc_feature (12)..(12): bicyclic nucleic acid (BNA)
  misc_feature (19)..(19): bicyclic nucleic acid (BNA)
tcaaggaagatggcatttctag

SEQ ID NO: 11261 - DNA, 22 bp, Artificial Sequence
  Description of Artificial Sequence: Synthetic Antisense oligonucleotide
  misc_feature (12)..(12): bicyclic nucleic acid (BNA)
  misc_feature (14)..(14): bicyclic nucleic acid (BNA)
tcaaggaagatggcatttctag

SEQ ID NO: 11262 - DNA, 22 bp, Artificial Sequence
  Description of Artificial Sequence: Synthetic Antisense oligonucleotide
  misc_feature (6)..(6): bicyclic nucleic acid (BNA)
  misc_feature (12)..(12): bicyclic nucleic acid (BNA)
tcaaggaagatggcatttctag

SEQ ID NO: 11263 - DNA, 22 bp, Artificial Sequence
  Description of Artificial Sequence: Synthetic Antisense oligonucleotide
  misc_feature (5)..(6): bicyclic nucleic acid (BNA)
tcaaggaagatggcatttctag

SEQ ID NO: 11264 - DNA, 22 bp, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
tcaaggaagatggcatttctag

SEQ ID NO: 11265 - DNA, 22 bp, Artificial Sequence
  Description of Artificial Sequence: Synthetic Antisense oligonucleotide
  misc_feature (9)..(9): bicyclic nucleic acid (BNA)
  misc_feature (12)..(12): bicyclic nucleic acid (BNA)
tcaaggaagatggcatttctag

SEQ ID NO: 11266 - DNA, 22 bp, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
tcaaggaagatggcatttctag

SEQ ID NO: 11267 - DNA, 22 bp, Artificial Sequence
  Description of Artificial Sequence: Synthetic Antisense oligonucleotide
  misc_feature (13)..(13): bicyclic nucleic acid (BNA)
  misc_feature (19)..(19): bicyclic nucleic acid (BNA)
tcaaggaagatggcatttctag

SEQ ID NO: 11268 - DNA, 22 bp, Artificial Sequence
  Description of Artificial Sequence: Synthetic Antisense oligonucleotide
  misc_feature (12)..(13): bicyclic nucleic acid (BNA)
tcaaggaagatggcatttctag

SEQ ID NO: 11269 - DNA, 22 bp, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
tcaaggaagatggcatttctag

SEQ ID NO: 11270 - DNA, 22 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
tcaaggaagatggcatttctag

SEQ ID NO: 11271 - DNA, 22 bp, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
tcaaggaagatggcatttctag

SEQ ID NO: 11272 - DNA, 22 bp, Artificial Sequence
  Description of Artificial Sequence: Synthetic Antisense oligonucleotide
  misc_feature (2)..(2): bicyclic nucleic acid (BNA)
  misc_feature (19)..(19): bicyclic nucleic acid (BNA)
tcaaggaagatggcatttctag

SEQ ID NO: 11273 - DNA, 22 bp, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
tcaaggaagatggcatttctag

SEQ ID NO: 11274 - DNA, 22 bp, Artificial Sequence
  Description of Artificial Sequence: Synthetic Antisense oligonucleotide
  misc_feature (14)..(14): bicyclic nucleic acid (BNA)
  misc_feature (19)..(19): bicyclic nucleic acid (BNA)
tcaaggaagatggcatttctag

SEQ ID NO: 11275 - DNA, 22 bp, Artificial Sequence
  Description of Artificial Sequence: Synthetic Antisense oligonucleotide
  misc_feature (9)..(9): bicyclic nucleic acid (BNA)
  misc_feature (19)..(19): bicyclic nucleic acid (BNA)
tcaaggaagatggcatttctag

SEQ ID NO: 11276 - DNA, 18 bp, Artificial Sequence
  Description of Artificial Sequence: Synthetic Antisense oligonucleotide
  misc_feature (2)..(2): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 11277 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
ggtaagttctgtccaagc

SEQ ID NO: 11278 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
ggtaagttctgtccaagc

SEQ ID NO: 11279 - DNA, 18 bp, Artificial Sequence
  Description of Artificial Sequence: Synthetic Antisense oligonucleotide
  misc_feature (6)..(6): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 11280 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (17)..(17): bicyclic nucleic acid (BNA)
ggtaagttctgtccaagc

SEQ ID NO: 11281 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (13)..(13): bicyclic nucleic acid (BNA)
ggtaagttctgtccaagc

SEQ ID NO: 11282 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (14)..(14): bicyclic nucleic acid (BNA)
ggtaagttctgtccaagc

SEQ ID NO: 11283 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (16)..(16): bicyclic nucleic acid (BNA)
gtaagttctgtccaagcc

SEQ ID NO: 11284 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
gtaagttctgtccaagcc

SEQ ID NO: 11285 - DNA, 18 bp, Artificial Sequence
  Description of Artificial Sequence: Synthetic Antisense oligonucleotide
  misc_feature (5)..(5): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 11286 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (17)..(17): bicyclic nucleic acid (BNA)
gtaagttctgtccaagcc

SEQ ID NO: 11287 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(12): bicyclic nucleic acid (BNA)
gtaagttctgtccaagcc

SEQ ID NO: 11288 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (13)..(13): bicyclic nucleic acid (BNA)
gtaagttctgtccaagcc

SEQ ID NO: 11289 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
gtaagttctgtccaagcc

SEQ ID NO: 11290 - DNA, 18 bp, Artificial Sequence
  Description of Artificial Sequence: Synthetic Antisense oligonucleotide
  misc_feature (2)..(2): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 11291 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
agtcggtaagttctgtcc

SEQ ID NO: 11292 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
agtcggtaagttctgtcc

SEQ ID NO: 11293 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
agtcggtaagttctgtcc

SEQ ID NO: 11294 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
agtcggtaagttctgtcc

SEQ ID NO: 11295 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (17)..(17): bicyclic nucleic acid (BNA)
agtcggtaagttctgtcc

SEQ ID NO: 11296 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (13)..(13): bicyclic nucleic acid (BNA)
agtcggtaagttctgtcc

SEQ ID NO: 11297 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (15)..(15): bicyclic nucleic acid (BNA)
agtcggtaagttctgtcc

SEQ ID NO: 11298 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
ctgtccaagcccggttga

SEQ ID NO: 11299 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
ctgtccaagcccggttga

SEQ ID NO: 11300 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
ctgtccaagcccggttga

SEQ ID NO: 11301 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
ctgtccaagcccggttga

SEQ ID NO: 11302 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
ctgtccaagcccggttga

SEQ ID NO: 11303 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
ctgtccaagcccggttga

SEQ ID NO: 11304 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (17)..(17): bicyclic nucleic acid (BNA)
ctgtccaagcccggttga

SEQ ID NO: 11305 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(12): bicyclic nucleic acid (BNA)
ctgtccaagcccggttga

SEQ ID NO: 11306 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(13): bicyclic nucleic acid (BNA)
ctgtccaagcccggttga

SEQ ID NO: 11307 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (14)..(14): bicyclic nucleic acid (BNA)
ctgtccaagcccggttga

SEQ ID NO: 11308 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (14)..(14): bicyclic nucleic acid (BNA)
ggtaagttctgtccaagc

SEQ ID NO: 11309 - DNA, 18 bp, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 11310 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (13)..(13): bicyclic nucleic acid (BNA)
  misc_feature (17)..(17): bicyclic nucleic acid (BNA)
ggtaagttctgtccaagc

SEQ ID NO: 11311 - DNA, 18 bp, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 11312 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (13)..(14): bicyclic nucleic acid (BNA)
ggtaagttctgtccaagc

SEQ ID NO: 11313 - DNA, 18 bp, Artificial Sequence
  Description of Artificial Sequence: Synthetic Antisense oligonucleotide
  misc_feature (2)..(2): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 11314 - DNA, 18 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 11315 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (11)..(11): bicyclic nucleic acid (BNA)
ggtaagttctgtccaagc

SEQ ID NO: 11316 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (14)..(14): bicyclic nucleic acid (BNA)
  misc_feature (17)..(17): bicyclic nucleic acid (BNA)
ggtaagttctgtccaagc

SEQ ID NO: 11317 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (13)..(13): bicyclic nucleic acid (BNA)
ggtaagttctgtccaagc

SEQ ID NO: 11318 - DNA, 18 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 11319 - DNA, 18 bp, Artificial Sequence
  Description of Artificial Sequence: Synthetic Antisense oligonucleotide
  misc_feature (2)..(2): bicyclic nucleic acid (BNA)
  misc_feature (11)..(11): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 11320 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (17)..(17): bicyclic nucleic acid (BNA)
ggtaagttctgtccaagc

SEQ ID NO: 11321 - DNA, 18 bp, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 11322 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (14)..(14): bicyclic nucleic acid (BNA)
ggtaagttctgtccaagc

SEQ ID NO: 11323 - DNA, 18 bp, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 11324 - DNA, 18 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 11325 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (13)..(13): bicyclic nucleic acid (BNA)
ggtaagttctgtccaagc

SEQ ID NO: 11326 - DNA, 18 bp, Artificial Sequence
  Description of Artificial Sequence: Synthetic Antisense oligonucleotide
  misc_feature (6)..(6): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 11327 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (17)..(17): bicyclic nucleic acid (BNA)
ggtaagttctgtccaagc

SEQ ID NO: 11328 - DNA, 18 bp, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 11329 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(12): bicyclic nucleic acid (BNA)
  misc_feature (17)..(17): bicyclic nucleic acid (BNA)
gtaagttctgtccaagcc

SEQ ID NO: 11330 - DNA, 18 bp, Artificial Sequence
  Description of Artificial Sequence: Synthetic Antisense oligonucleotide
  misc_feature (5)..(5): bicyclic nucleic acid (BNA)
  misc_feature (8)..(8): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 11331 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (13)..(13): bicyclic nucleic acid (BNA)
gtaagttctgtccaagcc

SEQ ID NO: 11332 - DNA, 18 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 11333 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (17)..(17): bicyclic nucleic acid (BNA)
gtaagttctgtccaagcc

SEQ ID NO: 11334 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (13)..(13): bicyclic nucleic acid (BNA)
  misc_feature (17)..(17): bicyclic nucleic acid (BNA)
gtaagttctgtccaagcc

SEQ ID NO: 11335 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (12)..(12): bicyclic nucleic acid (BNA)
gtaagttctgtccaagcc

SEQ ID NO: 11336 - DNA, 18 bp, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 11337 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (16)..(16): bicyclic nucleic acid (BNA)
gtaagttctgtccaagcc

SEQ ID NO: 11338 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (16)..(16): bicyclic nucleic acid (BNA)
gtaagttctgtccaagcc

SEQ ID NO: 11339 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (12)..(12): bicyclic nucleic acid (BNA)
gtaagttctgtccaagcc

SEQ ID NO: 11340 - DNA, 18 bp, Artificial Sequence
  Description of Artificial Sequence: Synthetic Antisense oligonucleotide
  misc_feature (5)..(5): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 11341 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (17)..(17): bicyclic nucleic acid (BNA)
gtaagttctgtccaagcc

SEQ ID NO: 11342 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(13): bicyclic nucleic acid (BNA)
gtaagttctgtccaagcc

SEQ ID NO: 11343 - DNA, 18 bp, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 11344 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (10)..(10): bicyclic nucleic acid (BNA)
gtaagttctgtccaagcc

SEQ ID NO: 11345 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (13)..(13): bicyclic nucleic acid (BNA)
  misc_feature (16)..(16): bicyclic nucleic acid (BNA)
gtaagttctgtccaagcc

SEQ ID NO: 11346 - DNA, 18 bp, Artificial Sequence
  Description of Artificial Sequence: Synthetic Antisense oligonucleotide
  misc_feature (5)..(5): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 11347 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(12): bicyclic nucleic acid (BNA)
  misc_feature (16)..(16): bicyclic nucleic acid (BNA)
gtaagttctgtccaagcc

SEQ ID NO: 11348 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (16)..(17): bicyclic nucleic acid (BNA)
gtaagttctgtccaagcc

SEQ ID NO: 11349 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (13)..(13): bicyclic nucleic acid (BNA)
gtaagttctgtccaagcc

SEQ ID NO: 11350 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (10)..(10): bicyclic nucleic acid (BNA)
agtcggtaagttctgtcc

SEQ ID NO: 11351 - DNA, 18 bp, Artificial Sequence
  Description of Artificial Sequence: Synthetic Antisense oligonucleotide
  misc_feature (2)..(2): bicyclic nucleic acid (BNA)
  misc_feature (4)..(4): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 11352 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (13)..(13): bicyclic nucleic acid (BNA)
agtcggtaagttctgtcc

SEQ ID NO: 11353 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (13)..(13): bicyclic nucleic acid (BNA)
  misc_feature (17)..(17): bicyclic nucleic acid (BNA)
agtcggtaagttctgtcc

SEQ ID NO: 11354 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (15)..(15): bicyclic nucleic acid (BNA)
agtcggtaagttctgtcc

SEQ ID NO: 11355 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (10)..(10): bicyclic nucleic acid (BNA)
agtcggtaagttctgtcc

SEQ ID NO: 11356 - DNA, 18 bp, Artificial Sequence
  Description of Artificial Sequence: Synthetic Antisense oligonucleotide
  misc_feature (2)..(2): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 11357 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (13)..(13): bicyclic nucleic acid (BNA)
agtcggtaagttctgtcc

SEQ ID NO: 11358 - DNA, 18 bp, Artificial Sequence
  Description of Artificial Sequence: Synthetic Antisense oligonucleotide
  misc_feature (2)..(2): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 11359 - DNA, 18 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 11360 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (17)..(17): bicyclic nucleic acid (BNA)
agtcggtaagttctgtcc

SEQ ID NO: 11361 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (15)..(15): bicyclic nucleic acid (BNA)
agtcggtaagttctgtcc

SEQ ID NO: 11362 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (13)..(13): bicyclic nucleic acid (BNA)
  misc_feature (15)..(15): bicyclic nucleic acid (BNA)
agtcggtaagttctgtcc

SEQ ID NO: 11363 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(6): bicyclic nucleic acid (BNA)
agtcggtaagttctgtcc

SEQ ID NO: 11364 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (15)..(15): bicyclic nucleic acid (BNA)
agtcggtaagttctgtcc

SEQ ID NO: 11365 - DNA, 18 bp, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 11366 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (17)..(17): bicyclic nucleic acid (BNA)
agtcggtaagttctgtcc

SEQ ID NO: 11367 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (17)..(17): bicyclic nucleic acid (BNA)
agtcggtaagttctgtcc

SEQ ID NO: 11368 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (10)..(10): bicyclic nucleic acid (BNA)
agtcggtaagttctgtcc

SEQ ID NO: 11369 - DNA, 18 bp, Artificial Sequence
  Description of Artificial Sequence: Synthetic Antisense oligonucleotide
  misc_feature (2)..(2): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 11370 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (6)..(6): bicyclic nucleic acid (BNA)
agtcggtaagttctgtcc

SEQ ID NO: 11371 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (13)..(13): bicyclic nucleic acid (BNA)
agtcggtaagttctgtcc

SEQ ID NO: 11372 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (15)..(15): bicyclic nucleic acid (BNA)
  misc_feature (17)..(17): bicyclic nucleic acid (BNA)
agtcggtaagttctgtcc

SEQ ID NO: 11373 - DNA, 18 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 11374 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (17)..(17): bicyclic nucleic acid (BNA)
agtcggtaagttctgtcc

SEQ ID NO: 11375 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (15)..(15): bicyclic nucleic acid (BNA)
agtcggtaagttctgtcc

SEQ ID NO: 11376 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(5): bicyclic nucleic acid (BNA)
agtcggtaagttctgtcc

SEQ ID NO: 11377 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (13)..(13): bicyclic nucleic acid (BNA)
agtcggtaagttctgtcc

SEQ ID NO: 11378 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(12): bicyclic nucleic acid (BNA)
  misc_feature (17)..(17): bicyclic nucleic acid (BNA)
ctgtccaagcccggttga

SEQ ID NO: 11379 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (10)..(10): bicyclic nucleic acid (BNA)
ctgtccaagcccggttga

SEQ ID NO: 11380 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (14)..(14): bicyclic nucleic acid (BNA)
ctgtccaagcccggttga

SEQ ID NO: 11381 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(12): bicyclic nucleic acid (BNA)
ctgtccaagcccggttga

SEQ ID NO: 11382 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (9)..(9): bicyclic nucleic acid (BNA)
ctgtccaagcccggttga

SEQ ID NO: 11383 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (9)..(9): bicyclic nucleic acid (BNA)
ctgtccaagcccggttga

SEQ ID NO: 11384 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (14)..(14): bicyclic nucleic acid (BNA)
ctgtccaagcccggttga

SEQ ID NO: 11385 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(10): bicyclic nucleic acid (BNA)
ctgtccaagcccggttga

SEQ ID NO: 11386 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (13)..(13): bicyclic nucleic acid (BNA)
ctgtccaagcccggttga

SEQ ID NO: 11387 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (13)..(13): bicyclic nucleic acid (BNA)
ctgtccaagcccggttga

SEQ ID NO: 11388 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(13): bicyclic nucleic acid (BNA)
  misc_feature (17)..(17): bicyclic nucleic acid (BNA)
ctgtccaagcccggttga

SEQ ID NO: 11389 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (6)..(6): bicyclic nucleic acid (BNA)
ctgtccaagcccggttga

SEQ ID NO: 11390 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (9)..(9): bicyclic nucleic acid (BNA)
ctgtccaagcccggttga

SEQ ID NO: 11391 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (10)..(10): bicyclic nucleic acid (BNA)
ctgtccaagcccggttga

SEQ ID NO: 11392 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (10)..(10): bicyclic nucleic acid (BNA)
ctgtccaagcccggttga

SEQ ID NO: 11393 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(14): bicyclic nucleic acid (BNA)
ctgtccaagcccggttga

SEQ ID NO: 11394 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (13)..(13): bicyclic nucleic acid (BNA)
ctgtccaagcccggttga

SEQ ID NO: 11395 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (11)..(11): bicyclic nucleic acid (BNA)
ctgtccaagcccggttga

SEQ ID NO: 11396 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (14)..(14): bicyclic nucleic acid (BNA)
  misc_feature (17)..(17): bicyclic nucleic acid (BNA)
ctgtccaagcccggttga

SEQ ID NO: 11397 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (13)..(13): bicyclic nucleic acid (BNA)
ctgtccaagcccggttga

SEQ ID NO: 11398 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (14)..(14): bicyclic nucleic acid (BNA)
ctgtccaagcccggttga

SEQ ID NO: 11399 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (14)..(14): bicyclic nucleic acid (BNA)
ctgtccaagcccggttga

SEQ ID NO: 11400 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (12)..(12): bicyclic nucleic acid (BNA)
ctgtccaagcccggttga

SEQ ID NO: 11401 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (17)..(17): bicyclic nucleic acid (BNA)
ctgtccaagcccggttga

SEQ ID NO: 11402 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(12): bicyclic nucleic acid (BNA)
  misc_feature (14)..(14): bicyclic nucleic acid (BNA)
ctgtccaagcccggttga

SEQ ID NO: 11403 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (11)..(11): bicyclic nucleic acid (BNA)
ctgtccaagcccggttga

SEQ ID NO: 11404 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (17)..(17): bicyclic nucleic acid (BNA)
ctgtccaagcccggttga

SEQ ID NO: 11405 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (12)..(12): bicyclic nucleic acid (BNA)
ctgtccaagcccggttga

SEQ ID NO: 11406 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(6): bicyclic nucleic acid (BNA)
ctgtccaagcccggttga

SEQ ID NO: 11407 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (14)..(14): bicyclic nucleic acid (BNA)
ctgtccaagcccggttga

SEQ ID NO: 11408 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (12)..(12): bicyclic nucleic acid (BNA)
ctgtccaagcccggttga

SEQ ID NO: 11409 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (17)..(17): bicyclic nucleic acid (BNA)
ctgtccaagcccggttga

SEQ ID NO: 11410 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (11)..(11): bicyclic nucleic acid (BNA)
ctgtccaagcccggttga

SEQ ID NO: 11411 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(11): bicyclic nucleic acid (BNA)
ctgtccaagcccggttga

SEQ ID NO: 11412 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (17)..(17): bicyclic nucleic acid (BNA)
ctgtccaagcccggttga

SEQ ID NO: 11413 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(13): bicyclic nucleic acid (BNA)
ctgtccaagcccggttga

SEQ ID NO: 11414 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (12)..(12): bicyclic nucleic acid (BNA)
ctgtccaagcccggttga

SEQ ID NO: 11415 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (14)..(14): bicyclic nucleic acid (BNA)
ctgtccaagcccggttga

SEQ ID NO: 11416 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (11)..(11): bicyclic nucleic acid (BNA)
ctgtccaagcccggttga

SEQ ID NO: 11417 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (17)..(17): bicyclic nucleic acid (BNA)
ctgtccaagcccggttga

SEQ ID NO: 11418 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (13)..(13): bicyclic nucleic acid (BNA)
ctgtccaagcccggttga

SEQ ID NO: 11419 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (17)..(17): bicyclic nucleic acid (BNA)
ctgtccaagcccggttga

SEQ ID NO: 11420 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (12)..(12): bicyclic nucleic acid (BNA)
ctgtccaagcccggttga

SEQ ID NO: 11421 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (5)..(5): bicyclic nucleic acid (BNA)
ctgtccaagcccggttga

SEQ ID NO: 11422 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (13)..(13): bicyclic nucleic acid (BNA)
ctgtccaagcccggttga

SEQ ID NO: 11423 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
tcaaggaagatggcatttct

SEQ ID NO: 11424 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
tcaaggaagatggcatttct

SEQ ID NO: 11425 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
tcaaggaagatggcatttct

SEQ ID NO: 11426 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
tcaaggaagatggcatttct

SEQ ID NO: 11427 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
tcaaggaagatggcatttct

SEQ ID NO: 11428 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
tcaaggaagatggcatttct

SEQ ID NO: 11429 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (19)..(19): bicyclic nucleic acid (BNA)
tcaaggaagatggcatttct

SEQ ID NO: 11430 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
tcaaggaagatggcatttct

SEQ ID NO: 11431 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
tcaaggaagatggcatttctag

SEQ ID NO: 11432 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
tcaaggaagatggcatttctag

SEQ ID NO: 11433 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
tcaaggaagatggcatttctag

SEQ ID NO: 11434 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
tcaaggaagatggcatttctag

SEQ ID NO: 11435 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
tcaaggaagatggcatttctag

SEQ ID NO: 11436 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
tcaaggaagatggcatttctag

SEQ ID NO: 11437 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (19)..(19): bicyclic nucleic acid (BNA)
tcaaggaagatggcatttctag

SEQ ID NO: 11438 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
tcaaggaagatggcatttctag

SEQ ID NO: 11439 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (14)..(14): bicyclic nucleic acid (BNA)
tcaaggaagatggcatttct

SEQ ID NO: 11440 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (9)..(9): bicyclic nucleic acid (BNA)
tcaaggaagatggcatttct

SEQ ID NO: 11441 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (19)..(19): bicyclic nucleic acid (BNA)
tcaaggaagatggcatttct

SEQ ID NO: 11442 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (14)..(14): bicyclic nucleic acid (BNA)
tcaaggaagatggcatttct

SEQ ID NO: 11443 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (13)..(13): bicyclic nucleic acid (BNA)
tcaaggaagatggcatttct

SEQ ID NO: 11444 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (12)..(12): bicyclic nucleic acid (BNA)
tcaaggaagatggcatttct

SEQ ID NO: 11445 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (9)..(9): bicyclic nucleic acid (BNA)
tcaaggaagatggcatttct

SEQ ID NO: 11446 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(14): bicyclic nucleic acid (BNA)
tcaaggaagatggcatttct

SEQ ID NO: 11447 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (13)..(13): bicyclic nucleic acid (BNA)
tcaaggaagatggcatttct

SEQ ID NO: 11448 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (19)..(19): bicyclic nucleic acid (BNA)
tcaaggaagatggcatttct

SEQ ID NO: 11449 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (14)..(14): bicyclic nucleic acid (BNA)
tcaaggaagatggcatttct

SEQ ID NO: 11450 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (6)..(6): bicyclic nucleic acid (BNA)
tcaaggaagatggcatttct

SEQ ID NO: 11451 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (19)..(19): bicyclic nucleic acid (BNA)
tcaaggaagatggcatttct

SEQ ID NO: 11452 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (14)..(14): bicyclic nucleic acid (BNA)
tcaaggaagatggcatttct

SEQ ID NO: 11453 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (12)..(12): bicyclic nucleic acid (BNA)
tcaaggaagatggcatttct

SEQ ID NO: 11454 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(6): bicyclic nucleic acid (BNA)
tcaaggaagatggcatttct

SEQ ID NO: 11455 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (14)..(14): bicyclic nucleic acid (BNA)
tcaaggaagatggcatttct

SEQ ID NO: 11456 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (12)..(12): bicyclic nucleic acid (BNA)
tcaaggaagatggcatttct

SEQ ID NO: 11457 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (5)..(5): bicyclic nucleic acid (BNA)
tcaaggaagatggcatttct

SEQ ID NO: 11458 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
  misc_feature (19)..(19): bicyclic nucleic acid (BNA)
tcaaggaagatggcatttct

SEQ ID NO: 11459 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(13): bicyclic nucleic acid (BNA)
tcaaggaagatggcatttct

SEQ ID NO: 11460 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (12)..(12): bicyclic nucleic acid (BNA)
tcaaggaagatggcatttct

SEQ ID NO: 11461 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (13)..(13): bicyclic nucleic acid (BNA)
tcaaggaagatggcatttct

SEQ ID NO: 11462 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (13)..(13): bicyclic nucleic acid (BNA)
tcaaggaagatggcatttct

SEQ ID NO: 11463 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (19)..(19): bicyclic nucleic acid (BNA)
tcaaggaagatggcatttct

SEQ ID NO: 11464 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (9)..(9): bicyclic nucleic acid (BNA)
tcaaggaagatggcatttct

SEQ ID NO: 11465 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
  misc_feature (19)..(19): bicyclic nucleic acid (BNA)
tcaaggaagatggcatttct

SEQ ID NO: 11466 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (19)..(19): bicyclic nucleic acid (BNA)
tcaaggaagatggcatttct

SEQ ID NO: 11467 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (14)..(14): bicyclic nucleic acid (BNA)
tcaaggaagatggcatttctag

SEQ ID NO: 11468 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (9)..(9): bicyclic nucleic acid (BNA)
tcaaggaagatggcatttctag

SEQ ID NO: 11469 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (19)..(19): bicyclic nucleic acid (BNA)
tcaaggaagatggcatttctag

SEQ ID NO: 11470 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (14)..(14): bicyclic nucleic acid (BNA)
tcaaggaagatggcatttctag

SEQ ID NO: 11471 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (13)..(13): bicyclic nucleic acid (BNA)
tcaaggaagatggcatttctag

SEQ ID NO: 11472 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (12)..(12): bicyclic nucleic acid (BNA)
tcaaggaagatggcatttctag

SEQ ID NO: 11473 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (9)..(9): bicyclic nucleic acid (BNA)
tcaaggaagatggcatttctag

SEQ ID NO: 11474 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(14): bicyclic nucleic acid (BNA)
tcaaggaagatggcatttctag

SEQ ID NO: 11475 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (13)..(13): bicyclic nucleic acid (BNA)
tcaaggaagatggcatttctag

SEQ ID NO: 11476 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (19)..(19): bicyclic nucleic acid (BNA)
tcaaggaagatggcatttctag

SEQ ID NO: 11477 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (14)..(14): bicyclic nucleic acid (BNA)
tcaaggaagatggcatttctag

SEQ ID NO: 11478 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (6)..(6): bicyclic nucleic acid (BNA)
tcaaggaagatggcatttctag

SEQ ID NO: 11479 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (19)..(19): bicyclic nucleic acid (BNA)
tcaaggaagatggcatttctag

SEQ ID NO: 11480 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (14)..(14): bicyclic nucleic acid (BNA)
tcaaggaagatggcatttctag

SEQ ID NO: 11481 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (12)..(12): bicyclic nucleic acid (BNA)
tcaaggaagatggcatttctag

SEQ ID NO: 11482 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(6): bicyclic nucleic acid (BNA)
tcaaggaagatggcatttctag

SEQ ID NO: 11483 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (14)..(14): bicyclic nucleic acid (BNA)
tcaaggaagatggcatttctag

SEQ ID NO: 11484 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (12)..(12): bicyclic nucleic acid (BNA)
tcaaggaagatggcatttctag

SEQ ID NO: 11485 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (5)..(5): bicyclic nucleic acid (BNA)
tcaaggaagatggcatttctag

SEQ ID NO: 11486 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
  misc_feature (19)..(19): bicyclic nucleic acid (BNA)
tcaaggaagatggcatttctag

SEQ ID NO: 11487 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(13): bicyclic nucleic acid (BNA)
tcaaggaagatggcatttctag

SEQ ID NO: 11488 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (12)..(12): bicyclic nucleic acid (BNA)
tcaaggaagatggcatttctag

SEQ ID NO: 11489 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (13)..(13): bicyclic nucleic acid (BNA)
tcaaggaagatggcatttctag

SEQ ID NO: 11490 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (13)..(13): bicyclic nucleic acid (BNA)
tcaaggaagatggcatttctag

SEQ ID NO: 11491 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (19)..(19): bicyclic nucleic acid (BNA)
tcaaggaagatggcatttctag

SEQ ID NO: 11492 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (9)..(9): bicyclic nucleic acid (BNA)
tcaaggaagatggcatttctag

SEQ ID NO: 11493 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
  misc_feature (19)..(19): bicyclic nucleic acid (BNA)
tcaaggaagatggcatttctag

SEQ ID NO: 11494 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (19)..(19): bicyclic nucleic acid (BNA)
tcaaggaagatggcatttctag

SEQ ID NO: 11495 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
gguaaguucuguccaagc

SEQ ID NO: 11496 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
gguaaguucuguccaagc

SEQ ID NO: 11497 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
gguaaguucuguccaagc

SEQ ID NO: 11498 - RNA, 18 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
gguaaguucuguccaagc

SEQ ID NO: 11499 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
gguaaguucuguccaagc

SEQ ID NO: 11500 - RNA, 18 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
gguaaguucuguccaagc

SEQ ID NO: 11501 - RNA, 18 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
guaaguucuguccaagcc

SEQ ID NO: 11502 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
guaaguucuguccaagcc

SEQ ID NO: 11503 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
guaaguucuguccaagcc

SEQ ID NO: 11504 - RNA, 18 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
guaaguucuguccaagcc

SEQ ID NO: 11505 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
guaaguucuguccaagcc

SEQ ID NO: 11506 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
guaaguucuguccaagcc

SEQ ID NO: 11507 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
guaaguucuguccaagcc

SEQ ID NO: 11508 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
agucgguaaguucugucc

SEQ ID NO: 11509 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
agucgguaaguucugucc

SEQ ID NO: 11510 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
agucgguaaguucugucc

SEQ ID NO: 11511 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
agucgguaaguucugucc

SEQ ID NO: 11512 - RNA, 18 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
agucgguaaguucugucc

SEQ ID NO: 11513 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
agucgguaaguucugucc

SEQ ID NO: 11514 - RNA, 18 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
agucgguaaguucugucc

SEQ ID NO: 11515 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
cuguccaagcccgguuga

SEQ ID NO: 11516 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
cuguccaagcccgguuga

SEQ ID NO: 11517 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
cuguccaagcccgguuga

SEQ ID NO: 11518 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
cuguccaagcccgguuga

SEQ ID NO: 11519 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
cuguccaagcccgguuga

SEQ ID NO: 11520 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
cuguccaagcccgguuga

SEQ ID NO: 11521 - RNA, 18 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
cuguccaagcccgguuga

SEQ ID NO: 11522 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
cuguccaagcccgguuga

SEQ ID NO: 11523 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
cuguccaagcccgguuga

SEQ ID NO: 11524 - RNA, 18 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
cuguccaagcccgguuga

SEQ ID NO: 11525 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (11)..(11): bicyclic nucleic acid (BNA)
gguaaguucuguccaagc

SEQ ID NO: 11526 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
gguaaguucuguccaagc

SEQ ID NO: 11527 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(17): bicyclic nucleic acid (BNA)
gguaaguucuguccaagc

SEQ ID NO: 11528 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
gguaaguucuguccaagc

SEQ ID NO: 11529 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
gguaaguucuguccaagc

SEQ ID NO: 11530 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (17)..(17): bicyclic nucleic acid (BNA)
gguaaguucuguccaagc

SEQ ID NO: 11531 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (14)..(14): bicyclic nucleic acid (BNA)
gguaaguucuguccaagc

SEQ ID NO: 11532 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
gguaaguucuguccaagc

SEQ ID NO: 11533 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
gguaaguucuguccaagc

SEQ ID NO: 11534 - RNA, 18 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (17)..(17): bicyclic nucleic acid (BNA)
gguaaguucuguccaagc

SEQ ID NO: 11535 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (11)..(11): bicyclic nucleic acid (BNA)
gguaaguucuguccaagc

SEQ ID NO: 11536 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (13)..(13): bicyclic nucleic acid (BNA)
gguaaguucuguccaagc

SEQ ID NO: 11537 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(17): bicyclic nucleic acid (BNA)
gguaaguucuguccaagc

SEQ ID NO: 11538 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (17)..(17): bicyclic nucleic acid (BNA)
gguaaguucuguccaagc

SEQ ID NO: 11539 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
gguaaguucuguccaagc

SEQ ID NO: 11540 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (17)..(17): bicyclic nucleic acid (BNA)
guaaguucuguccaagcc

SEQ ID NO: 11541 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (8)..(8): bicyclic nucleic acid (BNA)
guaaguucuguccaagcc

SEQ ID NO: 11542 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (13)..(13): bicyclic nucleic acid (BNA)
guaaguucuguccaagcc

SEQ ID NO: 11543 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
guaaguucuguccaagcc

SEQ ID NO: 11544 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (17)..(17): bicyclic nucleic acid (BNA)
guaaguucuguccaagcc

SEQ ID NO: 11545 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(17): bicyclic nucleic acid (BNA)
guaaguucuguccaagcc

SEQ ID NO: 11546 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (12)..(12): bicyclic nucleic acid (BNA)
guaaguucuguccaagcc

SEQ ID NO: 11547 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
guaaguucuguccaagcc

SEQ ID NO: 11548 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (16)..(16): bicyclic nucleic acid (BNA)
guaaguucuguccaagcc

SEQ ID NO: 11549 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (16)..(16): bicyclic nucleic acid (BNA)
guaaguucuguccaagcc

SEQ ID NO: 11550 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (12)..(12): bicyclic nucleic acid (BNA)
guaaguucuguccaagcc

SEQ ID NO: 11551 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(17): bicyclic nucleic acid (BNA)
guaaguucuguccaagcc

SEQ ID NO: 11552 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(17): bicyclic nucleic acid (BNA)
guaaguucuguccaagcc

SEQ ID NO: 11553 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
guaaguucuguccaagcc

SEQ ID NO: 11554 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
guaaguucuguccaagcc

SEQ ID NO: 11555 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (10)..(10): bicyclic nucleic acid (BNA)
guaaguucuguccaagcc

SEQ ID NO: 11556 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (16)..(16): bicyclic nucleic acid (BNA)
guaaguucuguccaagcc

SEQ ID NO: 11557 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (16)..(16): bicyclic nucleic acid (BNA)
guaaguucuguccaagcc

SEQ ID NO: 11558 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (16)..(16): bicyclic nucleic acid (BNA)
guaaguucuguccaagcc

SEQ ID NO: 11559 - RNA, 18 nt, Artificial Sequence
  Description of Artificial Sequence: Synthetic Antisense oligonucleotide
  misc_feature (1)..(1): bicyclic nucleic acid (BNA)
  misc_feature (16)..(17): bicyclic nucleic acid (BNA)
guaaguucuguccaagcc

SEQ ID NO: 11560 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
guaaguucuguccaagcc

SEQ ID NO: 11561 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
agucgguaaguucugucc

SEQ ID NO: 11562 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
agucgguaaguucugucc

SEQ ID NO: 11563 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(17): bicyclic nucleic acid (BNA)
agucgguaaguucugucc

SEQ ID NO: 11564 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (15)..(15): bicyclic nucleic acid (BNA)
agucgguaaguucugucc

SEQ ID NO: 11565 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
agucgguaaguucugucc

SEQ ID NO: 11566 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
agucgguaaguucugucc

SEQ ID NO: 11567 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (17)..(17): bicyclic nucleic acid (BNA)
agucgguaaguucugucc

SEQ ID NO: 11568 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (15)..(15): bicyclic nucleic acid (BNA)
agucgguaaguucugucc

SEQ ID NO: 11569 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (15)..(15): bicyclic nucleic acid (BNA)
agucgguaaguucugucc

SEQ ID NO: 11570 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
agucgguaaguucugucc

SEQ ID NO: 11571 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (15)..(15): bicyclic nucleic acid (BNA)
agucgguaaguucugucc

SEQ ID NO: 11572 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(17): bicyclic nucleic acid (BNA)
agucgguaaguucugucc

SEQ ID NO: 11573 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(17): bicyclic nucleic acid (BNA)
agucgguaaguucugucc

SEQ ID NO: 11574 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (10)..(10): bicyclic nucleic acid (BNA)
agucgguaaguucugucc

SEQ ID NO: 11575 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (6)..(6): bicyclic nucleic acid (BNA)
agucgguaaguucugucc

SEQ ID NO: 11576 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (13)..(13): bicyclic nucleic acid (BNA)
agucgguaaguucugucc

SEQ ID NO: 11577 - RNA, 18 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (17)..(17): bicyclic nucleic acid (BNA)
agucgguaaguucugucc

SEQ ID NO: 11578 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(17): bicyclic nucleic acid (BNA)
agucgguaaguucugucc

SEQ ID NO: 11579 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (15)..(15): bicyclic nucleic acid (BNA)
agucgguaaguucugucc

SEQ ID NO: 11580 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(5): bicyclic nucleic acid (BNA)
agucgguaaguucugucc

SEQ ID NO: 11581 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
agucgguaaguucugucc

SEQ ID NO: 11582 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (17)..(17): bicyclic nucleic acid (BNA)
cuguccaagcccgguuga

SEQ ID NO: 11583 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
cuguccaagcccgguuga

SEQ ID NO: 11584 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
cuguccaagcccgguuga

SEQ ID NO: 11585 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(12): bicyclic nucleic acid (BNA)
cuguccaagcccgguuga

SEQ ID NO: 11586 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
cuguccaagcccgguuga

SEQ ID NO: 11587 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (9)..(9): bicyclic nucleic acid (BNA)
cuguccaagcccgguuga

SEQ ID NO: 11588 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
cuguccaagcccgguuga

SEQ ID NO: 11589 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(10): bicyclic nucleic acid (BNA)
cuguccaagcccgguuga

SEQ ID NO: 11590 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
cuguccaagcccgguuga

SEQ ID NO: 11591 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (13)..(13): bicyclic nucleic acid (BNA)
cuguccaagcccgguuga

SEQ ID NO: 11592 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(17): bicyclic nucleic acid (BNA)
cuguccaagcccgguuga

SEQ ID NO: 11593 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (6)..(6): bicyclic nucleic acid (BNA)
cuguccaagcccgguuga

SEQ ID NO: 11594 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
cuguccaagcccgguuga

SEQ ID NO: 11595 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
cuguccaagcccgguuga

SEQ ID NO: 11596 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (10)..(10): bicyclic nucleic acid (BNA)
cuguccaagcccgguuga

SEQ ID NO: 11597 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
cuguccaagcccgguuga

SEQ ID NO: 11598 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
cuguccaagcccgguuga

SEQ ID NO: 11599 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (11)..(11): bicyclic nucleic acid (BNA)
cuguccaagcccgguuga

SEQ ID NO: 11600 - RNA, 18 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (17)..(17): bicyclic nucleic acid (BNA)
cuguccaagcccgguuga

SEQ ID NO: 11601 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (13)..(13): bicyclic nucleic acid (BNA)
cuguccaagcccgguuga

SEQ ID NO: 11602 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
cuguccaagcccgguuga

SEQ ID NO: 11603 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (14)..(14): bicyclic nucleic acid (BNA)
cuguccaagcccgguuga

SEQ ID NO: 11604 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (12)..(12): bicyclic nucleic acid (BNA)
cuguccaagcccgguuga

SEQ ID NO: 11605 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (17)..(17): bicyclic nucleic acid (BNA)
cuguccaagcccgguuga

SEQ ID NO: 11606 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
cuguccaagcccgguuga

SEQ ID NO: 11607 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (11)..(11): bicyclic nucleic acid (BNA)
cuguccaagcccgguuga

SEQ ID NO: 11608 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (17)..(17): bicyclic nucleic acid (BNA)
cuguccaagcccgguuga

SEQ ID NO: 11609 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
cuguccaagcccgguuga

SEQ ID NO: 11610 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
cuguccaagcccgguuga

SEQ ID NO: 11611 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (14)..(14): bicyclic nucleic acid (BNA)
cuguccaagcccgguuga

SEQ ID NO: 11612 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
cuguccaagcccgguuga

SEQ ID NO: 11613 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(17): bicyclic nucleic acid (BNA)
cuguccaagcccgguuga

SEQ ID NO: 11614 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (11)..(11): bicyclic nucleic acid (BNA)
cuguccaagcccgguuga

SEQ ID NO: 11615 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(11): bicyclic nucleic acid (BNA)
cuguccaagcccgguuga

SEQ ID NO: 11616 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(17): bicyclic nucleic acid (BNA)
cuguccaagcccgguuga

SEQ ID NO: 11617 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
cuguccaagcccgguuga

SEQ ID NO: 11618 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
cuguccaagcccgguuga

SEQ ID NO: 11619 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (14)..(14): bicyclic nucleic acid (BNA)
cuguccaagcccgguuga

SEQ ID NO: 11620 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (11)..(11): bicyclic nucleic acid (BNA)
cuguccaagcccgguuga

SEQ ID NO: 11621 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(17): bicyclic nucleic acid (BNA)
cuguccaagcccgguuga

SEQ ID NO: 11622 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
cuguccaagcccgguuga

SEQ ID NO: 11623 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (17)..(17): bicyclic nucleic acid (BNA)
cuguccaagcccgguuga

SEQ ID NO: 11624 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (12)..(12): bicyclic nucleic acid (BNA)
cuguccaagcccgguuga

SEQ ID NO: 11625 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (5)..(5): bicyclic nucleic acid (BNA)
cuguccaagcccgguuga

SEQ ID NO: 11626 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
cuguccaagcccgguuga

SEQ ID NO: 11627 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
tcaaggaagauggcauuucu

SEQ ID NO: 11628 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
tcaaggaagauggcauuucu

SEQ ID NO: 11629 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
tcaaggaagauggcauuucu

SEQ ID NO: 11630 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
tcaaggaagauggcauuucu

SEQ ID NO: 11631 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
tcaaggaagauggcauuucu

SEQ ID NO: 11632 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
tcaaggaagauggcauuucu

SEQ ID NO: 11633 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
tcaaggaagauggcauuucu

SEQ ID NO: 11634 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
tcaaggaagauggcauuucuag

SEQ ID NO: 11635 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
tcaaggaagauggcauuucuag

SEQ ID NO: 11636 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
tcaaggaagauggcauuucuag

SEQ ID NO: 11637 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
tcaaggaagauggcauuucuag

SEQ ID NO: 11638 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
tcaaggaagauggcauuucuag

SEQ ID NO: 11639 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
tcaaggaagauggcauuucuag

SEQ ID NO: 11640 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
tcaaggaagauggcauuucuag

SEQ ID NO: 11641 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
tcaaggaagauggcauuucu

SEQ ID NO: 11642 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
tcaaggaagauggcauuucu

SEQ ID NO: 11643 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (19)..(19): bicyclic nucleic acid (BNA)
tcaaggaagauggcauuucu

SEQ ID NO: 11644 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
tcaaggaagauggcauuucu

SEQ ID NO: 11645 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
tcaaggaagauggcauuucu

SEQ ID NO: 11646 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
tcaaggaagauggcauuucu

SEQ ID NO: 11647 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(14): bicyclic nucleic acid (BNA)
tcaaggaagauggcauuucu

SEQ ID NO: 11648 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
tcaaggaagauggcauuucu

SEQ ID NO: 11649 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (19)..(19): bicyclic nucleic acid (BNA)
tcaaggaagauggcauuucu

SEQ ID NO: 11650 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
tcaaggaagauggcauuucu

SEQ ID NO: 11651 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (19)..(19): bicyclic nucleic acid (BNA)
tcaaggaagauggcauuucu

SEQ ID NO: 11652 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
tcaaggaagauggcauuucu

SEQ ID NO: 11653 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
tcaaggaagauggcauuucu

SEQ ID NO: 11654 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(6): bicyclic nucleic acid (BNA)
tcaaggaagauggcauuucu

SEQ ID NO: 11655 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
tcaaggaagauggcauuucu

SEQ ID NO: 11656 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (19)..(19): bicyclic nucleic acid (BNA)
tcaaggaagauggcauuucu

SEQ ID NO: 11657 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(13): bicyclic nucleic acid (BNA)
tcaaggaagauggcauuucu

SEQ ID NO: 11658 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
tcaaggaagauggcauuucu

SEQ ID NO: 11659 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
tcaaggaagauggcauuucu

SEQ ID NO: 11660 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (19)..(19): bicyclic nucleic acid (BNA)
tcaaggaagauggcauuucu

SEQ ID NO: 11661 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (19)..(19): bicyclic nucleic acid (BNA)
tcaaggaagauggcauuucu

SEQ ID NO: 11662 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
tcaaggaagauggcauuucuag

SEQ ID NO: 11663 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
tcaaggaagauggcauuucuag

SEQ ID NO: 11664 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (19)..(19): bicyclic nucleic acid (BNA)
tcaaggaagauggcauuucuag

SEQ ID NO: 11665 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
tcaaggaagauggcauuucuag

SEQ ID NO: 11666 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
tcaaggaagauggcauuucuag

SEQ ID NO: 11667 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
tcaaggaagauggcauuucuag

SEQ ID NO: 11668 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(14): bicyclic nucleic acid (BNA)
tcaaggaagauggcauuucuag

SEQ ID NO: 11669 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
tcaaggaagauggcauuucuag

SEQ ID NO: 11670 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (19)..(19): bicyclic nucleic acid (BNA)
tcaaggaagauggcauuucuag

SEQ ID NO: 11671 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
tcaaggaagauggcauuucuag

SEQ ID NO: 11672 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (19)..(19): bicyclic nucleic acid (BNA)
tcaaggaagauggcauuucuag

SEQ ID NO: 11673 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
tcaaggaagauggcauuucuag

SEQ ID NO: 11674 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
tcaaggaagauggcauuucuag

SEQ ID NO: 11675 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(6): bicyclic nucleic acid (BNA)
tcaaggaagauggcauuucuag

SEQ ID NO: 11676 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
tcaaggaagauggcauuucuag

SEQ ID NO: 11677 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (19)..(19): bicyclic nucleic acid (BNA)
tcaaggaagauggcauuucuag

SEQ ID NO: 11678 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(13): bicyclic nucleic acid (BNA)
tcaaggaagauggcauuucuag

SEQ ID NO: 11679 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
tcaaggaagauggcauuucuag

SEQ ID NO: 11680 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
tcaaggaagauggcauuucuag

SEQ ID NO: 11681 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (19)..(19): bicyclic nucleic acid (BNA)
tcaaggaagauggcauuucuag

SEQ ID NO: 11682 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (19)..(19): bicyclic nucleic acid (BNA)
tcaaggaagauggcauuucuag

SEQ ID NO: 11683 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11684 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11685 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11686 - RNA, 18 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11687 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11688 - RNA, 18 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11689 - RNA, 18 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11690 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11691 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11692 - RNA, 18 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11693 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11694 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11695 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11696 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11697 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11698 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11699 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11700 - RNA, 18 nt, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11701 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11702 - RNA, 18 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11703 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
cuguccaagcccgguuga

SEQ ID NO: 11704 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
cuguccaagcccgguuga

SEQ ID NO: 11705 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
cuguccaagcccgguuga

SEQ ID NO: 11706 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
cuguccaagcccgguuga

SEQ ID NO: 11707 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(11): bicyclic nucleic acid (BNA)
cuguccaagcccgguuga

SEQ ID NO: 11708 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
cuguccaagcccgguuga

SEQ ID NO: 11709 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (17)..(17): bicyclic nucleic acid (BNA)
cuguccaagcccgguuga

SEQ ID NO: 11710 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(12): bicyclic nucleic acid (BNA)
cuguccaagcccgguuga

SEQ ID NO: 11711 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(13): bicyclic nucleic acid (BNA)
cuguccaagcccgguuga

SEQ ID NO: 11712 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (14)..(14): bicyclic nucleic acid (BNA)
cuguccaagcccgguuga

SEQ ID NO: 11713 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (11)..(11): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11714 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11715 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11716 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11717 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11718 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11719 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11720 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11721 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11722 - RNA, 18 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11723 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (11)..(11): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11724 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11725 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11726 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11727 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 11728 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11729 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (8)..(8): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11730 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11731 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11732 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11733 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11734 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11735 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11736 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11737 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11738 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11739 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11740 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11741 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11742 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11743 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (10)..(10): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11744 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11745 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11746 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11747 - RNA, 18 nt, Artificial Sequence
  Description of Artificial Sequence: Synthetic Antisense oligonucleotide
  misc_feature (1)..(1): bicyclic nucleic acid (BNA)
  misc_feature (16)..(17): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11748 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 11749 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11750 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11751 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11752 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11753 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11754 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11755 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11756 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11757 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11758 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11759 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11760 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11761 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11762 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11763 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (6)..(6): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11764 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11765 - RNA, 18 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11766 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11767 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11768 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(5): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11769 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 11770 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(12): bicyclic nucleic acid (BNA)
  misc_feature (17)..(17): bicyclic nucleic acid (BNA)
cuguccaagcccgguuga

SEQ ID NO: 11771 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
cuguccaagcccgguuga

SEQ ID NO: 11772 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
cuguccaagcccgguuga

SEQ ID NO: 11773 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(12): bicyclic nucleic acid (BNA)
cuguccaagcccgguuga

SEQ ID NO: 11774 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
cuguccaagcccgguuga

SEQ ID NO: 11775 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (9)..(9): bicyclic nucleic acid (BNA)
cuguccaagcccgguuga

SEQ ID NO: 11776 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
cuguccaagcccgguuga

SEQ ID NO: 11777 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(10): bicyclic nucleic acid (BNA)
cuguccaagcccgguuga

SEQ ID NO: 11778 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
cuguccaagcccgguuga

SEQ ID NO: 11779 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (13)..(13): bicyclic nucleic acid (BNA)
cuguccaagcccgguuga

SEQ ID NO: 11780 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(13): bicyclic nucleic acid (BNA)
  misc_feature (17)..(17): bicyclic nucleic acid (BNA)
cuguccaagcccgguuga

SEQ ID NO: 11781 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (6)..(6): bicyclic nucleic acid (BNA)
cuguccaagcccgguuga

SEQ ID NO: 11782 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
cuguccaagcccgguuga

SEQ ID NO: 11783 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
cuguccaagcccgguuga

SEQ ID NO: 11784 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (10)..(10): bicyclic nucleic acid (BNA)
cuguccaagcccgguuga

SEQ ID NO: 11785 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(14): bicyclic nucleic acid (BNA)
cuguccaagcccgguuga

SEQ ID NO: 11786 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
cuguccaagcccgguuga

SEQ ID NO: 11787 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (11)..(11): bicyclic nucleic acid (BNA)
cuguccaagcccgguuga

SEQ ID NO: 11788 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (14)..(14): bicyclic nucleic acid (BNA)
  misc_feature (17)..(17): bicyclic nucleic acid (BNA)
cuguccaagcccgguuga

SEQ ID NO: 11789 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(11): bicyclic nucleic acid (BNA)
  misc_feature (13)..(13): bicyclic nucleic acid (BNA)
cuguccaagcccgguuga

SEQ ID NO: 11790 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
cuguccaagcccgguuga

SEQ ID NO: 11791 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (14)..(14): bicyclic nucleic acid (BNA)
cuguccaagcccgguuga

SEQ ID NO: 11792 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (12)..(12): bicyclic nucleic acid (BNA)
cuguccaagcccgguuga

SEQ ID NO: 11793 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (17)..(17): bicyclic nucleic acid (BNA)
cuguccaagcccgguuga

SEQ ID NO: 11794 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
cuguccaagcccgguuga

SEQ ID NO: 11795 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (11)..(11): bicyclic nucleic acid (BNA)
cuguccaagcccgguuga

SEQ ID NO: 11796 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (17)..(17): bicyclic nucleic acid (BNA)
cuguccaagcccgguuga

SEQ ID NO: 11797 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
cuguccaagcccgguuga

SEQ ID NO: 11798 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(6): bicyclic nucleic acid (BNA)
cuguccaagcccgguuga

SEQ ID NO: 11799 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(11): bicyclic nucleic acid (BNA)
  misc_feature (14)..(14): bicyclic nucleic acid (BNA)
cuguccaagcccgguuga

SEQ ID NO: 11800 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
cuguccaagcccgguuga

SEQ ID NO: 11801 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (17)..(17): bicyclic nucleic acid (BNA)
cuguccaagcccgguuga

SEQ ID NO: 11802 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (11)..(11): bicyclic nucleic acid (BNA)
cuguccaagcccgguuga

SEQ ID NO: 11803 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(11): bicyclic nucleic acid (BNA)
cuguccaagcccgguuga

SEQ ID NO: 11804 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (17)..(17): bicyclic nucleic acid (BNA)
cuguccaagcccgguuga

SEQ ID NO: 11805 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(13): bicyclic nucleic acid (BNA)
cuguccaagcccgguuga

SEQ ID NO: 11806 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
cuguccaagcccgguuga

SEQ ID NO: 11807 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (14)..(14): bicyclic nucleic acid (BNA)
cuguccaagcccgguuga

SEQ ID NO: 11808 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (11)..(11): bicyclic nucleic acid (BNA)
cuguccaagcccgguuga

SEQ ID NO: 11809 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (17)..(17): bicyclic nucleic acid (BNA)
cuguccaagcccgguuga

SEQ ID NO: 11810 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
cuguccaagcccgguuga

SEQ ID NO: 11811 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(11): bicyclic nucleic acid (BNA)
  misc_feature (17)..(17): bicyclic nucleic acid (BNA)
cuguccaagcccgguuga

SEQ ID NO: 11812 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (12)..(12): bicyclic nucleic acid (BNA)
cuguccaagcccgguuga

SEQ ID NO: 11813 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (5)..(5): bicyclic nucleic acid (BNA)
cuguccaagcccgguuga

SEQ ID NO: 11814 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
cuguccaagcccgguuga

SEQ ID NO: 11815 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11816 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11817 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11818 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11819 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11820 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11821 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11822 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11823 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11824 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11825 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11826 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11827 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11828 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11829 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11830 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11831 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11832 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11833 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11834 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11835 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11836 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11837 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11838 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11839 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11840 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11841 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11842 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(6): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11843 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11844 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11845 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11846 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11847 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11848 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11849 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 11850 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11851 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11852 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11853 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11854 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11855 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11856 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11857 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11858 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11859 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11860 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11861 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11862 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11863 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(6): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11864 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11865 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11866 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11867 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11868 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11869 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11870 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 11871 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
ggtaagttctgtccaagc

SEQ ID NO: 11872 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
ggtaagttctgtccaagc

SEQ ID NO: 11873 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
ggtaagttctgtccaagc

SEQ ID NO: 11874 - DNA, 18 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
ggtaagttctgtccaagc

SEQ ID NO: 11875 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
ggtaagttctgtccaagc

SEQ ID NO: 11876 - DNA, 18 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
ggtaagttctgtccaagc

SEQ ID NO: 11877 - DNA, 18 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
gtaagttctgtccaagcc

SEQ ID NO: 11878 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
gtaagttctgtccaagcc

SEQ ID NO: 11879 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
gtaagttctgtccaagcc

SEQ ID NO: 11880 - DNA, 18 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
gtaagttctgtccaagcc

SEQ ID NO: 11881 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
gtaagttctgtccaagcc

SEQ ID NO: 11882 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
gtaagttctgtccaagcc

SEQ ID NO: 11883 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
gtaagttctgtccaagcc

SEQ ID NO: 11884 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
agtcggtaagttctgtcc

SEQ ID NO: 11885 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
agtcggtaagttctgtcc

SEQ ID NO: 11886 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
agtcggtaagttctgtcc

SEQ ID NO: 11887 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
agtcggtaagttctgtcc

SEQ ID NO: 11888 - DNA, 18 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
agtcggtaagttctgtcc

SEQ ID NO: 11889 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
agtcggtaagttctgtcc

SEQ ID NO: 11890 - DNA, 18 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
agtcggtaagttctgtcc

SEQ ID NO: 11891 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
ctgtccaagcccggttga

SEQ ID NO: 11892 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
ctgtccaagcccggttga

SEQ ID NO: 11893 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
ctgtccaagcccggttga

SEQ ID NO: 11894 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
ctgtccaagcccggttga

SEQ ID NO: 11895 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
ctgtccaagcccggttga

SEQ ID NO: 11896 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
ctgtccaagcccggttga

SEQ ID NO: 11897 - DNA, 18 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
ctgtccaagcccggttga

SEQ ID NO: 11898 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
ctgtccaagcccggttga

SEQ ID NO: 11899 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
ctgtccaagcccggttga

SEQ ID NO: 11900 - DNA, 18 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
ctgtccaagcccggttga

SEQ ID NO: 11901 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (11)..(11): bicyclic nucleic acid (BNA)
ggtaagttctgtccaagc

SEQ ID NO: 11902 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
ggtaagttctgtccaagc

SEQ ID NO: 11903 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(17): bicyclic nucleic acid (BNA)
ggtaagttctgtccaagc

SEQ ID NO: 11904 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
ggtaagttctgtccaagc

SEQ ID NO: 11905 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
ggtaagttctgtccaagc

SEQ ID NO: 11906 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (17)..(17): bicyclic nucleic acid (BNA)
ggtaagttctgtccaagc

SEQ ID NO: 11907 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (14)..(14): bicyclic nucleic acid (BNA)
ggtaagttctgtccaagc

SEQ ID NO: 11908 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
ggtaagttctgtccaagc

SEQ ID NO: 11909 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
ggtaagttctgtccaagc

SEQ ID NO: 11910 - DNA, 18 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (17)..(17): bicyclic nucleic acid (BNA)
ggtaagttctgtccaagc

SEQ ID NO: 11911 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (11)..(11): bicyclic nucleic acid (BNA)
ggtaagttctgtccaagc

SEQ ID NO: 11912 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (13)..(13): bicyclic nucleic acid (BNA)
ggtaagttctgtccaagc

SEQ ID NO: 11913 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(17): bicyclic nucleic acid (BNA)
ggtaagttctgtccaagc

SEQ ID NO: 11914 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (17)..(17): bicyclic nucleic acid (BNA)
ggtaagttctgtccaagc

SEQ ID NO: 11915 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
ggtaagttctgtccaagc

SEQ ID NO: 11916 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (17)..(17): bicyclic nucleic acid (BNA)
gtaagttctgtccaagcc

SEQ ID NO: 11917 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (8)..(8): bicyclic nucleic acid (BNA)
gtaagttctgtccaagcc

SEQ ID NO: 11918 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (13)..(13): bicyclic nucleic acid (BNA)
gtaagttctgtccaagcc

SEQ ID NO: 11919 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
gtaagttctgtccaagcc

SEQ ID NO: 11920 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (17)..(17): bicyclic nucleic acid (BNA)
gtaagttctgtccaagcc

SEQ ID NO: 11921 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(17): bicyclic nucleic acid (BNA)
gtaagttctgtccaagcc

SEQ ID NO: 11922 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (12)..(12): bicyclic nucleic acid (BNA)
gtaagttctgtccaagcc

SEQ ID NO: 11923 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
gtaagttctgtccaagcc

SEQ ID NO: 11924 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (16)..(16): bicyclic nucleic acid (BNA)
gtaagttctgtccaagcc

SEQ ID NO: 11925 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (16)..(16): bicyclic nucleic acid (BNA)
gtaagttctgtccaagcc

SEQ ID NO: 11926 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (12)..(12): bicyclic nucleic acid (BNA)
gtaagttctgtccaagcc

SEQ ID NO: 11927 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(17): bicyclic nucleic acid (BNA)
gtaagttctgtccaagcc

SEQ ID NO: 11928 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(17): bicyclic nucleic acid (BNA)
gtaagttctgtccaagcc

SEQ ID NO: 11929 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
gtaagttctgtccaagcc

SEQ ID NO: 11930 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
gtaagttctgtccaagcc

SEQ ID NO: 11931 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (10)..(10): bicyclic nucleic acid (BNA)
gtaagttctgtccaagcc

SEQ ID NO: 11932 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (16)..(16): bicyclic nucleic acid (BNA)
gtaagttctgtccaagcc

SEQ ID NO: 11933 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (16)..(16): bicyclic nucleic acid (BNA)
gtaagttctgtccaagcc

SEQ ID NO: 11934 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (16)..(16): bicyclic nucleic acid (BNA)
gtaagttctgtccaagcc

SEQ ID NO: 11935 - DNA, 18 bp, Artificial Sequence
  Description of Artificial Sequence: Synthetic Antisense oligonucleotide
  misc_feature (1)..(1): bicyclic nucleic acid (BNA)
  misc_feature (16)..(17): bicyclic nucleic acid (BNA)
gtaagttctgtccaagcc

SEQ ID NO: 11936 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
gtaagttctgtccaagcc

SEQ ID NO: 11937 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
agtcggtaagttctgtcc

SEQ ID NO: 11938 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
agtcggtaagttctgtcc

SEQ ID NO: 11939 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(17): bicyclic nucleic acid (BNA)
agtcggtaagttctgtcc

SEQ ID NO: 11940 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (15)..(15): bicyclic nucleic acid (BNA)
agtcggtaagttctgtcc

SEQ ID NO: 11941 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
agtcggtaagttctgtcc

SEQ ID NO: 11942 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
agtcggtaagttctgtcc

SEQ ID NO: 11943 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (17)..(17): bicyclic nucleic acid (BNA)
agtcggtaagttctgtcc

SEQ ID NO: 11944 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (15)..(15): bicyclic nucleic acid (BNA)
agtcggtaagttctgtcc

SEQ ID NO: 11945 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (15)..(15): bicyclic nucleic acid (BNA)
agtcggtaagttctgtcc

SEQ ID NO: 11946 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
agtcggtaagttctgtcc

SEQ ID NO: 11947 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (15)..(15): bicyclic nucleic acid (BNA)
agtcggtaagttctgtcc

SEQ ID NO: 11948 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(17): bicyclic nucleic acid (BNA)
agtcggtaagttctgtcc

SEQ ID NO: 11949 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(17): bicyclic nucleic acid (BNA)
agtcggtaagttctgtcc

SEQ ID NO: 11950 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (10)..(10): bicyclic nucleic acid (BNA)
agtcggtaagttctgtcc

SEQ ID NO: 11951 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (6)..(6): bicyclic nucleic acid (BNA)
agtcggtaagttctgtcc

SEQ ID NO: 11952 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (13)..(13): bicyclic nucleic acid (BNA)
agtcggtaagttctgtcc

SEQ ID NO: 11953 - DNA, 18 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (17)..(17): bicyclic nucleic acid (BNA)
agtcggtaagttctgtcc

SEQ ID NO: 11954 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(17): bicyclic nucleic acid (BNA)
agtcggtaagttctgtcc

SEQ ID NO: 11955 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (15)..(15): bicyclic nucleic acid (BNA)
agtcggtaagttctgtcc

SEQ ID NO: 11956 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(5): bicyclic nucleic acid (BNA)
agtcggtaagttctgtcc

SEQ ID NO: 11957 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
agtcggtaagttctgtcc

SEQ ID NO: 11958 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (17)..(17): bicyclic nucleic acid (BNA)
ctgtccaagcccggttga

SEQ ID NO: 11959 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
ctgtccaagcccggttga

SEQ ID NO: 11960 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
ctgtccaagcccggttga

SEQ ID NO: 11961 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(12): bicyclic nucleic acid (BNA)
ctgtccaagcccggttga

SEQ ID NO: 11962 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
ctgtccaagcccggttga

SEQ ID NO: 11963 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (9)..(9): bicyclic nucleic acid (BNA)
ctgtccaagcccggttga

SEQ ID NO: 11964 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
ctgtccaagcccggttga

SEQ ID NO: 11965 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(10): bicyclic nucleic acid (BNA)
ctgtccaagcccggttga

SEQ ID NO: 11966 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
ctgtccaagcccggttga

SEQ ID NO: 11967 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (13)..(13): bicyclic nucleic acid (BNA)
ctgtccaagcccggttga

SEQ ID NO: 11968 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(17): bicyclic nucleic acid (BNA)
ctgtccaagcccggttga

SEQ ID NO: 11969 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (6)..(6): bicyclic nucleic acid (BNA)
ctgtccaagcccggttga

SEQ ID NO: 11970 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
ctgtccaagcccggttga

SEQ ID NO: 11971 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
ctgtccaagcccggttga

SEQ ID NO: 11972 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (10)..(10): bicyclic nucleic acid (BNA)
ctgtccaagcccggttga

SEQ ID NO: 11973 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
ctgtccaagcccggttga

SEQ ID NO: 11974 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
ctgtccaagcccggttga

SEQ ID NO: 11975 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (11)..(11): bicyclic nucleic acid (BNA)
ctgtccaagcccggttga

SEQ ID NO: 11976 - DNA, 18 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (17)..(17): bicyclic nucleic acid (BNA)
ctgtccaagcccggttga

SEQ ID NO: 11977 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (13)..(13): bicyclic nucleic acid (BNA)
ctgtccaagcccggttga

SEQ ID NO: 11978 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
ctgtccaagcccggttga

SEQ ID NO: 11979 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (14)..(14): bicyclic nucleic acid (BNA)
ctgtccaagcccggttga

SEQ ID NO: 11980 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (12)..(12): bicyclic nucleic acid (BNA)
ctgtccaagcccggttga

SEQ ID NO: 11981 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (17)..(17): bicyclic nucleic acid (BNA)
ctgtccaagcccggttga

SEQ ID NO: 11982 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
ctgtccaagcccggttga

SEQ ID NO: 11983 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (11)..(11): bicyclic nucleic acid (BNA)
ctgtccaagcccggttga

SEQ ID NO: 11984 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (17)..(17): bicyclic nucleic acid (BNA)
ctgtccaagcccggttga

SEQ ID NO: 11985 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
ctgtccaagcccggttga

SEQ ID NO: 11986 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
ctgtccaagcccggttga

SEQ ID NO: 11987 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (14)..(14): bicyclic nucleic acid (BNA)
ctgtccaagcccggttga

SEQ ID NO: 11988 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
ctgtccaagcccggttga

SEQ ID NO: 11989 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(17): bicyclic nucleic acid (BNA)
ctgtccaagcccggttga

SEQ ID NO: 11990 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (11)..(11): bicyclic nucleic acid (BNA)
ctgtccaagcccggttga

SEQ ID NO: 11991 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(11): bicyclic nucleic acid (BNA)
ctgtccaagcccggttga

SEQ ID NO: 11992 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(17): bicyclic nucleic acid (BNA)
ctgtccaagcccggttga

SEQ ID NO: 11993 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
ctgtccaagcccggttga

SEQ ID NO: 11994 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
ctgtccaagcccggttga

SEQ ID NO: 11995 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (14)..(14): bicyclic nucleic acid (BNA)
ctgtccaagcccggttga

SEQ ID NO: 11996 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (11)..(11): bicyclic nucleic acid (BNA)
ctgtccaagcccggttga

SEQ ID NO: 11997 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(17): bicyclic nucleic acid (BNA)
ctgtccaagcccggttga

SEQ ID NO: 11998 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
ctgtccaagcccggttga

SEQ ID NO: 11999 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (17)..(17): bicyclic nucleic acid (BNA)
ctgtccaagcccggttga

SEQ ID NO: 12000 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (12)..(12): bicyclic nucleic acid (BNA)
ctgtccaagcccggttga

SEQ ID NO: 12001 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (5)..(5): bicyclic nucleic acid (BNA)
ctgtccaagcccggttga

SEQ ID NO: 12002 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
ctgtccaagcccggttga

SEQ ID NO: 12003 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
tcaaggaagatggcatttct

SEQ ID NO: 12004 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
tcaaggaagatggcatttct

SEQ ID NO: 12005 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
tcaaggaagatggcatttct

SEQ ID NO: 12006 - DNA, 20 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
tcaaggaagatggcatttct

SEQ ID NO: 12007 - DNA, 20 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
tcaaggaagatggcatttct

SEQ ID NO: 12008 - DNA, 20 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
tcaaggaagatggcatttct

SEQ ID NO: 12009 - DNA, 20 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
tcaaggaagatggcatttct

SEQ ID NO: 12010 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
tcaaggaagatggcatttctag

SEQ ID NO: 12011 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
tcaaggaagatggcatttctag

SEQ ID NO: 12012 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
tcaaggaagatggcatttctag

SEQ ID NO: 12013 - DNA, 22 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
tcaaggaagatggcatttctag

SEQ ID NO: 12014 - DNA, 22 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
tcaaggaagatggcatttctag

SEQ ID NO: 12015 - DNA, 22 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
tcaaggaagatggcatttctag

SEQ ID NO: 12016 - DNA, 22 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
tcaaggaagatggcatttctag

SEQ ID NO: 12017 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
tcaaggaagatggcatttct

SEQ ID NO: 12018 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
tcaaggaagatggcatttct

SEQ ID NO: 12019 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (19)..(19): bicyclic nucleic acid (BNA)
tcaaggaagatggcatttct

SEQ ID NO: 12020 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
tcaaggaagatggcatttct

SEQ ID NO: 12021 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
tcaaggaagatggcatttct

SEQ ID NO: 12022 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
tcaaggaagatggcatttct

SEQ ID NO: 12023 - DNA, 20 bp, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
tcaaggaagatggcatttct

SEQ ID NO: 12024 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
tcaaggaagatggcatttct

SEQ ID NO: 12025 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (19)..(19): bicyclic nucleic acid (BNA)
tcaaggaagatggcatttct

SEQ ID NO: 12026 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
tcaaggaagatggcatttct

SEQ ID NO: 12027 - DNA, 20 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (19)..(19): bicyclic nucleic acid (BNA)
tcaaggaagatggcatttct

SEQ ID NO: 12028 - DNA, 20 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
tcaaggaagatggcatttct

SEQ ID NO: 12029 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
tcaaggaagatggcatttct

SEQ ID NO: 12030 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
tcaaggaagatggcatttct

SEQ ID NO: 12031 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
tcaaggaagatggcatttct

SEQ ID NO: 12032 - DNA, 20 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (19)..(19): bicyclic nucleic acid (BNA)
tcaaggaagatggcatttct

SEQ ID NO: 12033 - DNA, 20 bp, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
tcaaggaagatggcatttct

SEQ ID NO: 12034 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
tcaaggaagatggcatttct

SEQ ID NO: 12035 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
tcaaggaagatggcatttct

SEQ ID NO: 12036 - DNA, 20 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (19)..(19): bicyclic nucleic acid (BNA)
tcaaggaagatggcatttct

SEQ ID NO: 12037 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (19)..(19): bicyclic nucleic acid (BNA)
tcaaggaagatggcatttct

SEQ ID NO: 12038 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
tcaaggaagatggcatttctag

SEQ ID NO: 12039 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
tcaaggaagatggcatttctag

SEQ ID NO: 12040 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (19)..(19): bicyclic nucleic acid (BNA)
tcaaggaagatggcatttctag

SEQ ID NO: 12041 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
tcaaggaagatggcatttctag

SEQ ID NO: 12042 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
tcaaggaagatggcatttctag

SEQ ID NO: 12043 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
tcaaggaagatggcatttctag

SEQ ID NO: 12044 - DNA, 22 bp, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
tcaaggaagatggcatttctag

SEQ ID NO: 12045 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
tcaaggaagatggcatttctag

SEQ ID NO: 12046 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (19)..(19): bicyclic nucleic acid (BNA)
tcaaggaagatggcatttctag

SEQ ID NO: 12047 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
tcaaggaagatggcatttctag

SEQ ID NO: 12048 - DNA, 22 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (19)..(19): bicyclic nucleic acid (BNA)
tcaaggaagatggcatttctag

SEQ ID NO: 12049 - DNA, 22 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
tcaaggaagatggcatttctag

SEQ ID NO: 12050 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
tcaaggaagatggcatttctag

SEQ ID NO: 12051 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
tcaaggaagatggcatttctag

SEQ ID NO: 12052 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
tcaaggaagatggcatttctag

SEQ ID NO: 12053 - DNA, 22 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (19)..(19): bicyclic nucleic acid (BNA)
tcaaggaagatggcatttctag

SEQ ID NO: 12054 - DNA, 22 bp, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
tcaaggaagatggcatttctag

SEQ ID NO: 12055 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
tcaaggaagatggcatttctag

SEQ ID NO: 12056 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
tcaaggaagatggcatttctag

SEQ ID NO: 12057 - DNA, 22 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (19)..(19): bicyclic nucleic acid (BNA)
tcaaggaagatggcatttctag

SEQ ID NO: 12058 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (19)..(19): bicyclic nucleic acid (BNA)
tcaaggaagatggcatttctag

SEQ ID NO: 12059 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12060 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12061 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12062 - DNA, 18 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12063 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12064 - DNA, 18 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12065 - DNA, 18 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12066 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12067 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12068 - DNA, 18 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12069 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12070 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12071 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12072 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12073 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12074 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12075 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12076 - DNA, 18 bp, Artificial Sequence
  Description of Artificial Sequence: Synthetic Antisense oligonucleotide
  misc_feature (1)..(1): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12077 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12078 - DNA, 18 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12079 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
ctgtccaagcccggttga

SEQ ID NO: 12080 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
ctgtccaagcccggttga

SEQ ID NO: 12081 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
ctgtccaagcccggttga

SEQ ID NO: 12082 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
ctgtccaagcccggttga

SEQ ID NO: 12083 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(11): bicyclic nucleic acid (BNA)
ctgtccaagcccggttga

SEQ ID NO: 12084 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
ctgtccaagcccggttga

SEQ ID NO: 12085 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (17)..(17): bicyclic nucleic acid (BNA)
ctgtccaagcccggttga

SEQ ID NO: 12086 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(12): bicyclic nucleic acid (BNA)
ctgtccaagcccggttga

SEQ ID NO: 12087 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(13): bicyclic nucleic acid (BNA)
ctgtccaagcccggttga

SEQ ID NO: 12088 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (14)..(14): bicyclic nucleic acid (BNA)
ctgtccaagcccggttga

SEQ ID NO: 12089 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (11)..(11): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12090 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12091 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12092 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12093 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12094 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12095 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12096 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12097 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12098 - DNA, 18 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12099 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (11)..(11): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12100 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12101 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12102 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12103 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12104 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12105 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (8)..(8): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12106 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12107 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12108 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12109 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12110 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12111 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12112 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12113 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12114 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12115 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12116 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12117 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12118 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12119 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (10)..(10): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12120 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12121 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12122 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12123 - DNA, 18 bp, Artificial Sequence
  Description of Artificial Sequence: Synthetic Antisense oligonucleotide
  misc_feature (1)..(1): bicyclic nucleic acid (BNA)
  misc_feature (16)..(17): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12124 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12125 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12126 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12127 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12128 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12129 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12130 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12131 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12132 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12133 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12134 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12135 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12136 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12137 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12138 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12139 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (6)..(6): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12140 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12141 - DNA, 18 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12142 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12143 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12144 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(5): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12145 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12146 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(12): bicyclic nucleic acid (BNA)
  misc_feature (17)..(17): bicyclic nucleic acid (BNA)
ctgtccaagcccggttga

SEQ ID NO: 12147 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
ctgtccaagcccggttga

SEQ ID NO: 12148 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
ctgtccaagcccggttga

SEQ ID NO: 12149 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(12): bicyclic nucleic acid (BNA)
ctgtccaagcccggttga

SEQ ID NO: 12150 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
ctgtccaagcccggttga

SEQ ID NO: 12151 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (9)..(9): bicyclic nucleic acid (BNA)
ctgtccaagcccggttga

SEQ ID NO: 12152 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
ctgtccaagcccggttga

SEQ ID NO: 12153 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(10): bicyclic nucleic acid (BNA)
ctgtccaagcccggttga

SEQ ID NO: 12154 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
ctgtccaagcccggttga

SEQ ID NO: 12155 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (13)..(13): bicyclic nucleic acid (BNA)
ctgtccaagcccggttga

SEQ ID NO: 12156 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(13): bicyclic nucleic acid (BNA)
  misc_feature (17)..(17): bicyclic nucleic acid (BNA)
ctgtccaagcccggttga

SEQ ID NO: 12157 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (6)..(6): bicyclic nucleic acid (BNA)
ctgtccaagcccggttga

SEQ ID NO: 12158 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
ctgtccaagcccggttga

SEQ ID NO: 12159 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
ctgtccaagcccggttga

SEQ ID NO: 12160 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (10)..(10): bicyclic nucleic acid (BNA)
ctgtccaagcccggttga

SEQ ID NO: 12161 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(14): bicyclic nucleic acid (BNA)
ctgtccaagcccggttga

SEQ ID NO: 12162 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
ctgtccaagcccggttga

SEQ ID NO: 12163 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (11)..(11): bicyclic nucleic acid (BNA)
ctgtccaagcccggttga

SEQ ID NO: 12164 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (14)..(14): bicyclic nucleic acid (BNA)
  misc_feature (17)..(17): bicyclic nucleic acid (BNA)
ctgtccaagcccggttga

SEQ ID NO: 12165 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(11): bicyclic nucleic acid (BNA)
  misc_feature (13)..(13): bicyclic nucleic acid (BNA)
ctgtccaagcccggttga

SEQ ID NO: 12166 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
ctgtccaagcccggttga

SEQ ID NO: 12167 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (14)..(14): bicyclic nucleic acid (BNA)
ctgtccaagcccggttga

SEQ ID NO: 12168 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (12)..(12): bicyclic nucleic acid (BNA)
ctgtccaagcccggttga

SEQ ID NO: 12169 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (17)..(17): bicyclic nucleic acid (BNA)
ctgtccaagcccggttga

SEQ ID NO: 12170 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
ctgtccaagcccggttga

SEQ ID NO: 12171 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (11)..(11): bicyclic nucleic acid (BNA)
ctgtccaagcccggttga

SEQ ID NO: 12172 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (17)..(17): bicyclic nucleic acid (BNA)
ctgtccaagcccggttga

SEQ ID NO: 12173 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
ctgtccaagcccggttga

SEQ ID NO: 12174 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(6): bicyclic nucleic acid (BNA)
ctgtccaagcccggttga

SEQ ID NO: 12175 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(11): bicyclic nucleic acid (BNA)
  misc_feature (14)..(14): bicyclic nucleic acid (BNA)
ctgtccaagcccggttga

SEQ ID NO: 12176 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
ctgtccaagcccggttga

SEQ ID NO: 12177 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (17)..(17): bicyclic nucleic acid (BNA)
ctgtccaagcccggttga

SEQ ID NO: 12178 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (11)..(11): bicyclic nucleic acid (BNA)
ctgtccaagcccggttga

SEQ ID NO: 12179 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(11): bicyclic nucleic acid (BNA)
ctgtccaagcccggttga

SEQ ID NO: 12180 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (17)..(17): bicyclic nucleic acid (BNA)
ctgtccaagcccggttga

SEQ ID NO: 12181 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(13): bicyclic nucleic acid (BNA)
ctgtccaagcccggttga

SEQ ID NO: 12182 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
ctgtccaagcccggttga

SEQ ID NO: 12183 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (14)..(14): bicyclic nucleic acid (BNA)
ctgtccaagcccggttga

SEQ ID NO: 12184 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (11)..(11): bicyclic nucleic acid (BNA)
ctgtccaagcccggttga

SEQ ID NO: 12185 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (17)..(17): bicyclic nucleic acid (BNA)
ctgtccaagcccggttga

SEQ ID NO: 12186 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
ctgtccaagcccggttga

SEQ ID NO: 12187 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(11): bicyclic nucleic acid (BNA)
  misc_feature (17)..(17): bicyclic nucleic acid (BNA)
ctgtccaagcccggttga

SEQ ID NO: 12188 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (12)..(12): bicyclic nucleic acid (BNA)
ctgtccaagcccggttga

SEQ ID NO: 12189 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (5)..(5): bicyclic nucleic acid (BNA)
ctgtccaagcccggttga

SEQ ID NO: 12190 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
ctgtccaagcccggttga

SEQ ID NO: 12191 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12192 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12193 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12194 - DNA, 20 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12195 - DNA, 20 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12196 - DNA, 20 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12197 - DNA, 20 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12198 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12199 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12200 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12201 - DNA, 22 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12202 - DNA, 22 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12203 - DNA, 22 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12204 - DNA, 22 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12205 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12206 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

(The sequence listing continues in the following parts.)

The invention claimed is:

1. A compound comprising a first and a second antisense oligonucleotide (AON) linked to each other by a linking moiety, wherein said first antisense oligonucleotide (AON) consists of the base sequence of SEQ ID NO: 14, and wherein said second antisense oligonucleotide (AON) consists of the base sequence of SEQ ID NO: 198, wherein sequences complementary to SEQ ID NO: 14 and 198 are located within exon 51 of dystrophin pre-mRNA.

2. A compound according to claim 1, wherein said linking moiety links the 3' terminal monomer of said first AON with the 5' terminal monomer of said second AON or links the 5' terminal monomer of said first AON with the 3' terminal monomer of said second AON.

3. A compound according to claim 1, wherein said linking moiety is a polyethylene glycol (PEG) linker, a triethylene glycol (TEG) or hexaethylene glycol (HEG) linker.

4. A compound according to claim 3, wherein said linking moiety is a triethylene glycol (TEG) or hexaethylene glycol (HEG) linker.

5. A compound according to claim 1, wherein said first and/or second antisense oligonucleotide comprises:
   i) at least one 2'-substituted monomer and optionally a phosphorothioate backbone linkage, and/or
   ii) a 5-methylcytosine and/or a 5-methyluracil base, and/or
   iii) at least one monomer comprising a bicyclic nucleic acid (BNA) scaffold modification.

6. A compound according to claim 5, wherein said first and/or second antisense oligonucleotide comprises only 2'-substituted monomers linked by phosphorothioate backbone linkages.

7. A compound according to claim 5, wherein all cytosine bases are 5-methylcytosine bases and/or wherein all uracil bases are 5-methyluracil bases of said first and/or second antisense oligonucleotide.

8. A compound according to claim 5, wherein said first and/or second antisense oligonucleotide comprises 1, 2, 3, 4, 5, 6, 7, 8 or 9 monomers that comprise a bicyclic nucleic acid (BNA) scaffold modification, a bridged nucleic acid scaffold modification, or a locked nucleic acid (LNA) scaffold modification.

9. A compound according to claim 8, wherein said first and/or second antisense oligonucleotide comprises 1, 2, 3, 4, 5, 6, 7, 8 or 9 monomers that comprise a bridged nucleic acid scaffold modification.

10. A compound according to claim 8, wherein said first and/or second antisense oligonucleotide comprises 1, 2, 3, 4, 5, 6, 7, 8 or 9 monomers that comprise a locked nucleic acid (LNA) scaffold modification.

11. A compound according to claim 8, wherein said first and/or second oligonucleotide comprises BNA modifications as selected from the set consisting of:
   (i) a single BNA scaffold modification in the monomer at the 5'-terminus,
   (ii) a single BNA scaffold modification in the monomer at the 3'-terminus,
   (iii) two BNA scaffold modifications where one is in the monomer at the 5'-terminus and the other is in the monomer at the 3'-terminus,
   (iv) two BNA scaffold modifications, one in each of the two monomers that are closest to the 5'-terminus,
   (v) two BNA scaffold modifications, one in each of the two monomers that are closest to the 3'-terminus, and
   (vi) four BNA scaffold modifications, one in each of the two monomers that are closest to the 5'-terminus and one in each of the two monomers that are closest to the 3'-terminus;
   wherein, optionally 1, 2, 3, 4 or 5 additional BNA scaffold modifications are present.

12. A compound according to claim 11, wherein said first antisense oligonucleotide is represented by a nucleotide sequence consisting of any one of:
   SEQ ID NO: 15911 to 15922, or 15977 to 15988 (derived from SEQ ID NO: 14), and wherein said second antisense oligonucleotide is represented by a nucleotide sequence consisting of any one of:
   SEQ ID NO: 15948 to 15962, or 16014 to 16028 (derived from SEQ ID NO: 198).

13. A composition comprising a compound according to claim 1 and a pharmaceutically acceptable carrier.

14. A method for treating Duchenne Muscular Dystrophy (DMD), comprising administering to a subject a compound according to claim 1.

15. A method for skipping of exon 51 of the dystrophin pre-mRNA, comprising administering to a subject a compound according to claim 1.

* * * * *